US012385061B2

(12) United States Patent
Ostertag et al.

(10) Patent No.: US 12,385,061 B2
(45) Date of Patent: Aug. 12, 2025

(54) COMPOSITIONS AND METHODS FOR CHIMERIC LIGAND RECEPTOR (CLR)-MEDIATED CONDITIONAL GENE EXPRESSION

(71) Applicant: Poseida Therapeutics, Inc., San Diego, CA (US)

(72) Inventors: Eric M. Ostertag, San Diego, CA (US); Devon Shedlock, San Diego, CA (US)

(73) Assignee: Poseida Therapeutics, Inc., San Diego, CA (US)

( * ) Notice: Subject to any disclaimer, the term of this patent is extended or adjusted under 35 U.S.C. 154(b) by 811 days.

(21) Appl. No.: 16/640,788

(22) PCT Filed: Sep. 10, 2018

(86) PCT No.: PCT/US2018/050288
§ 371 (c)(1),
(2) Date: Feb. 21, 2020

(87) PCT Pub. No.: WO2019/051424
PCT Pub. Date: Mar. 14, 2019

(65) Prior Publication Data
US 2021/0130845 A1 May 6, 2021

Related U.S. Application Data

(60) Provisional application No. 62/556,310, filed on Sep. 8, 2017.

(51) Int. Cl.
*C12N 15/85* (2006.01)
*A61K 40/11* (2025.01)
*A61K 40/31* (2025.01)
*A61K 40/40* (2025.01)
*A61K 40/42* (2025.01)
*A61P 7/04* (2006.01)
*C07K 14/725* (2006.01)
*C07K 16/28* (2006.01)
*C12N 9/06* (2006.01)
*C12N 9/64* (2006.01)

(52) U.S. Cl.
CPC .............. *C12N 15/85* (2013.01); *A61K 40/11* (2025.01); *A61K 40/31* (2025.01); *A61K 40/40* (2025.01); *A61K 40/4215* (2025.01); *A61P 7/04* (2018.01); *C07K 14/7051* (2013.01); *C07K 16/2878* (2013.01); *C12N 9/003* (2013.01); *C12N 9/644* (2013.01); *C12Y 105/01003* (2013.01); *C12Y 304/21022* (2013.01); *C07K 2319/02* (2013.01); *C07K 2319/03* (2013.01); *C12N 2830/002* (2013.01)

(58) Field of Classification Search
None
See application file for complete search history.

(56) References Cited

U.S. PATENT DOCUMENTS

| | | | |
|---|---|---|---|
| 4,309,989 | A | 1/1982 | Fahim |
| 4,656,134 | A | 4/1987 | Ringold |
| 4,683,195 | A | 7/1987 | Mullis et al. |
| 4,683,202 | A | 7/1987 | Mullis |
| 4,704,692 | A | 11/1987 | Ladner |
| 4,766,067 | A | 8/1988 | Biswas |
| 4,767,402 | A | 8/1988 | Kost et al. |
| 4,795,699 | A | 1/1989 | Tabor et al. |
| 4,800,159 | A | 1/1989 | Mullis et al. |
| 4,818,542 | A | 4/1989 | DeLuca et al. |
| 4,889,818 | A | 12/1989 | Gelfand et al. |
| 4,921,794 | A | 5/1990 | Tabor et al. |
| 4,939,666 | A | 7/1990 | Hardman |
| 4,946,778 | A | 8/1990 | Ladner et al. |
| 4,965,188 | A | 10/1990 | Mullis et al. |
| 4,994,370 | A | 2/1991 | Silver et al. |
| 5,066,584 | A | 11/1991 | Gyllensten et al. |
| 5,091,310 | A | 2/1992 | Innis |
| 5,122,464 | A | 6/1992 | Wilson et al. |
| 5,130,238 | A | 7/1992 | Malek et al. |

(Continued)

FOREIGN PATENT DOCUMENTS

| | | |
|---|---|---|
| WO | WO 91/17271 A1 | 11/1991 |
| WO | WO 91/18980 A1 | 12/1991 |

(Continued)

OTHER PUBLICATIONS

US 5,733,746 A, 03/1998, Treco et al. (withdrawn)
Chica et al. Curr Opin Biotechnol. Aug. 2005;16(4):378-84. (Year: 2005).*
Singh et al. Curr Protein Pept Sci. 2017, 18, 1-11 (Year: 2017).*
Chmielewski, M. and Abken, H. (Dec. 12, 2017) "CAR T Cells Releasing IL-18 Convert to T-Bet$^{high}$ FoxO1$^{low}$ Effectors that Exhibit Augmented Activity against Advanced Solid Tumors" Cell Reports, 21(11):P3205-3219; doi.org/10.1016/j.celrep.2017.11.063.
Kulemzin, S.V. et al. (Mar. 13, 2019) "Design and analysis of stably integrated reporters for inducible transgene expression in human T cells and CAR NK-cell lines" BMC Medical Genomics, 12(Suppl 2):44, doi.org/10.1186/s12920-019-0489-4, 9 pages.

(Continued)

*Primary Examiner* — Christian L Fronda
(74) *Attorney, Agent, or Firm* — Haley Guiliano LLP; Brian M. Gummow

(57) ABSTRACT

Disclosed are composition comprising (a) an inducible transgene construct, comprising a sequence encoding an inducible promoter and a sequence encoding a transgene, and (b) a receptor construct, comprising a sequence encoding a constitutive promoter and a sequence encoding an exogenous receptor, wherein, upon integration of the construct of (a) and the construct of (b) into a genomic sequence of a cell, the exogenous reporter is expressed, and wherein the exogenous reporter, upon binding a ligand, transduces an intracellular signal that targets the inducible promoter of (a) to modify gene expression. Methods for introducing compositions into cells and the use of the resultant cells in adoptive cell therapies are also provided.

14 Claims, 20 Drawing Sheets

Specification includes a Sequence Listing.

(56) References Cited

U.S. PATENT DOCUMENTS

| | | | |
|---|---|---|---|
| 5,142,033 A | 8/1992 | Innis | |
| 5,168,062 A | 12/1992 | Stinski | |
| 5,223,409 A | 6/1993 | Ladner et al. | |
| 5,260,203 A | 11/1993 | Ladner et al. | |
| 5,266,491 A | 11/1993 | Nagata et al. | |
| 5,385,839 A | 1/1995 | Stinski | |
| 5,403,484 A | 4/1995 | Ladner et al. | |
| 5,427,908 A | 6/1995 | Dower et al. | |
| 5,455,030 A | 10/1995 | Ladner et al. | |
| 5,518,889 A | 5/1996 | Ladner et al. | |
| 5,534,621 A | 7/1996 | Ladner et al. | |
| 5,571,698 A | 11/1996 | Ladner et al. | |
| 5,576,195 A | 11/1996 | Robinson et al. | |
| 5,580,717 A | 12/1996 | Dower et al. | |
| 5,580,734 A | 12/1996 | Treco et al. | |
| 5,595,898 A | 1/1997 | Robinson et al. | |
| 5,618,920 A | 4/1997 | Robinson et al. | |
| 5,641,670 A | 6/1997 | Treco et al. | |
| 5,643,768 A | 7/1997 | Kawasaki | |
| 5,656,730 A | 8/1997 | Lee | |
| 5,658,754 A | 8/1997 | Kawasaki | |
| 5,693,493 A | 12/1997 | Robinson et al. | |
| 5,698,417 A | 12/1997 | Robinson et al. | |
| 5,698,435 A | 12/1997 | Robinson et al. | |
| 5,733,761 A | 3/1998 | Treco et al. | |
| 5,750,373 A | 5/1998 | Garrard et al. | |
| 5,763,733 A | 6/1998 | Whitlow et al. | |
| 5,767,260 A | 6/1998 | Whitlow et al. | |
| 5,770,359 A | 6/1998 | Wilslon et al. | |
| 5,827,739 A | 10/1998 | Wilson et al. | |
| 5,837,500 A | 11/1998 | Ladner et al. | |
| 5,839,446 A | 11/1998 | Waner et al. | |
| 5,851,198 A | 12/1998 | Castellano et al. | |
| 5,856,456 A | 1/1999 | Whitlow et al. | |
| 5,885,793 A | 3/1999 | Griffiths et al. | |
| 6,019,968 A | 2/2000 | Platz et al. | |
| 8,556,882 B2 | 10/2013 | Morgan et al. | |
| 9,228,180 B2 | 1/2016 | Izsvak et al. | |
| 9,393,292 B2 | 7/2016 | Brenner | |
| 9,913,882 B2 | 3/2018 | Slawin et al. | |
| 10,041,077 B2 | 8/2018 | Minshull et al. | |
| 2012/0270300 A1* | 10/2012 | Enjolras | C12Y 304/21022 435/226 |
| 2018/0244797 A1* | 8/2018 | Pulé | C07K 16/3069 |
| 2020/0095573 A1* | 3/2020 | Wei | A61K 39/0011 |

FOREIGN PATENT DOCUMENTS

| | | |
|---|---|---|
| WO | WO 91/19818 A1 | 12/1991 |
| WO | WO 92/05258 A1 | 4/1992 |
| WO | WO 92/14843 A1 | 9/1992 |
| WO | WO 93/08278 A1 | 4/1993 |
| WO | WO 96/19256 A1 | 6/1996 |
| WO | WO 98/53847 A1 | 12/1998 |
| WO | WO 99/16419 A1 | 4/1999 |
| WO | WO 2006/133398 A2 | 12/2006 |
| WO | WO 2013/049275 A1 | 4/2013 |
| WO | WO 2013/123503 A1 | 8/2013 |
| WO | WO 2015/123642 A1 | 8/2015 |
| WO | WO 2017/023801 A1 | 2/2017 |
| WO | WO 2017/147538 A1 | 8/2017 |
| WO | WO-2017133633 A1 | 8/2017 |
| WO | WO-2018073394 A1 * 4/2018 | ............. A61K 35/17 |
| WO | WO 2018/213332 A1 | 11/2018 |
| WO | WO 2019/014390 A1 | 1/2019 |
| WO | WO-2019051424 A9 | 3/2019 |
| WO | WO-2020051374 A1 | 3/2020 |

OTHER PUBLICATIONS

Liu, Y. et al. (Jul. 2019) "Armored Inducible Expression of IL-12 Enhances Antitumor Activity of Glypican-3-Targeted Chimeric Antigen Receptor-Engineered T Cells in Hepatocellular Carcinoma" J Immunol, 203(1):198-207.

Moghimi, B. et al. (2021) "Preclinical assessment of the efficacy and specificity of GD2-B7H3 SynNotch CAR-T in metastatic neuroblastoma" Nat Commun, 12:511; doi.org/10.1038/s41467-020-20785-x, 15 pages.

Roybal, K.T. et al. (Oct. 6, 2016) "Engineering T Cells with Customized Therapeutic Response Programs Using Synthetic Notch Receptors" Cell, 167(2):P419-432,E16; doi.org/10.1016/j.cell.2016.09.011, 31 pages.

Uchibori, R. et al. (Mar. 2, 20199) "Functional Analysis of an Inducible Promoter Driven by Activation Signals from a Chimeric Antigen Receptor" Mol Ther Oncolytics, 12:16-25.

Zhang, L. et al. (May 2015) "Tumor-Infiltrating Lymphocytes Genetically Engineered with an Inducible Gene Encoding Interleukin-12 for the Immunotherapy of Metastatic Melanoma" Clin Cancer Res, 21(10):2278-2288.

Zimmerman, K. et al. (Feb. 6, 2020) "Design and Characterization of an "All-in-One" Lentiviral Vector System Combining Constitutive Anti-GD2 CAR Expression and Inducible Cytokines" Cancers, 12(2):375; doi: 10.3390/cancers12020375, 22 pages.

Nakagawa, T., et al. (2013) "Development of next-generation adoptive immunotherapy using chimeric antigen receptor (CAR)-expressing cytotoxic T cells (CTL)," Drug Delivery System, 28(1):35-44, English abstract only.

Higuchi, Y. (2013) "Development of optical imaging to visualize dynamics of cells in vivo" Drug Delivery System, 28(1):17-23.

Ando, M. and Nakauchi, H. (Mar. 1, 2017) "'Off-the-shelf' immunotherapy with iPSC-derived rejuvenated cytotoxic T lymphocytes", Experimental Hematology, 47:2-12.

Arcone, R. et al. (1988) "Identification of sequences responsible for acute-phase induciton of human C-reactive protein" Nucl Acids Res, 16(8):3195-3207.

Bojak, A. et al. (2002) "Muscle specific versus ubiquitous expression of Gag based HIV-1 DNA vaccines: a comparative analysis" Vaccine, 20:1975-1979.

Cazeaux, N. et al. (2002) "Comparative study of immune responses induced after immunization with plasmids encoding the HIV-1 Nef protein under the control of the CMV-IE or the muscle-specific desmin promoter" Vaccine, 20:3322-3331.

Cunningham, B.C. and J.A. Wells (Jun. 2, 1989) "High-Resolution Epitope Mapping of hGH-Receptor Interactions by Alanine-Scanning Mutagenesis" Science, 244:1081-1085.

De Vos, A.M. et al. (1992) "Human Growth Hormone and Extracellular Domain of Its Receptor: Crystal Structure of the Complex" Science, 255:306-312.

Donnelly, J.J. et al. (1997) "DNA Vaccines" Annu Rev Immunol, 15:617-648.

GenBank Accession No. AB 179012.1 (Oct. 6, 2006) "Macaca fascicularis testis cDNA clone: QtsA-11460, similar to human piggyBac transposable element derived 3 (PGBD3), mRNA, RefSeq: NM_170753.1" Bethesda (MD): National Library of Medicine (US), National Center for Biotechnology Information [online]. Retrieved from: https://www.ncbi.nlm.nih.gov/nuccore/AB179012, 3 pages.

GenBank Accession No. EU287451.1 (Mar. 1, 2008) "Macdunnoughia crassisigna transposon piggyBac McrPLE, complete sequence" Bethesda (MD): National Library of Medicine (US), National Center for Biotechnology Information [online]. Retrieved from: https://www.ncbi.nlm.nih.gov/nuccore/EU287451, 2 pages.

GenBank Accession No. GU270322.1 (Jan. 19, 2010) "Pectinophora gossypiella transposon piggyBac-like element PgPLE1.1 transposase gene, complete cds" Bethesda (MD): National Library of Medicine (US), National Center for Biotechnology Information [online]. Retrieved from: https://www.ncbi.nlm.nih.gov/nuccore/GU270322, 2 pages.

GenBank Accession No. GU329918.1 (Dec. 31, 2010) "Aphis gossypii transposon piggyBac-like element AgoPLE1.1 transposase gene, complete cds" Bethesda (MD): National Library of Medicine (US), National Center for Biotechnology Information [online]. Retrieved from: https://www.ncbi.nlm.nih.gov/nuccore/GU329918, 2 pages.

GenBank Accession No. GU477713.1 (Mar. 8, 2011) "Ctenoplusia agnata transposon piggyBac-like element PLE1.1 transposase gene,

(56) References Cited

OTHER PUBLICATIONS complete cds" Bethesda (MD): National Library of Medicine (US), National Center for Biotechnology Information [online]. Retrieved from: https://www.ncbi.nlm.nih.gov/nuccore/GU477713, 2 pages.
GenBank Accession No. GU477714.1 (Mar. 8, 2011) "Agrotis ipsilon transposon piggyBac-like element PLE1.1 transposase gene, complete cds" Bethesda (MD): National Library of Medicine (US), National Center for Biotechnology Information [online]. Retrieved from: https://www.ncbi.nlm.nih.gov/nuccore/GU477714, 2 pages.
GenBank Accession No. JX294476.1 (Jan. 30, 2015) "Chilo suppressalis transposon piggyBac-like element transposase (PLE1.1) gene, complete cds" Bethesda (MD): National Library of Medicine (US), National Center for Biotechnology Information [online]. Retrieved from: https://www.ncbi.nlm.nih.gov/nuccore/JX294476, 2 pages.
GenPept Accession No. AAA87375.2 (Oct. 15, 2002) "unknown protein [Trichoplusia ni]" Bethesda (MD): National Library of Medicine (US), National Center for Biotechnology Information [online]. Retrieved from: https://www.ncbi.nlm.nih.gov/protein/AAA87375.2, 2 pages.
GenPept Accession No. AAL39784.1 (Dec. 1, 20017) "LD40589p [*Drosophila melanogaster*]" Bethesda (MD): National Library of Medicine (US), National Center for Biotechnology Information [online]. Retrieved from: https://www.ncbi.nlm.nih.gov/protein/AAL39784, 2 pages.
GenPept Accession No. AAM76342.1 (Dec. 20, 2002) "putative transposase [Daphnia pulicaria]" Bethesda (MD): National Library of Medicine (US), National Center for Biotechnology Information [online]. Retrieved from: https://www.ncbi.nlm.nih.gov/protein/AAM76342.1, 1 page.
GenPept Accession No. ABD76335.1 (Aug. 3, 2006) "transposase [Heliothis virescens]" Bethesda (MD): National Library of Medicine (US), National Center for Biotechnology Information [online]. Retrieved from: https://www.ncbi.nlm.nih.gov/protein/ABD76335.1, 1 page.
GenPept Accession No. ABS18391.1 (Mar. 17, 2008) "transposase [Helicoverpa armigera]" Bethesda (MD): National Library of Medicine (US), National Center for Biotechnology Information [online]. Retrieved from: https://www.ncbi.nlm.nih.gov/protein/ABS18391.1, 1 page.
GenPept Accession No. BAD11135.1 (Sep. 15, 2007) "putative transposase yabusame-1 [Bombyx mori]" Bethesda (MD): National Library of Medicine (US), National Center for Biotechnology Information [online]. Retrieved from: https://www.ncbi.nlm.nih.gov/protein/BAD11135.1, 1 page.
GenPept Accession No. BAF82026.1 (Sep. 9, 2008) "piggyBac transposase Uribo2 [Xenopus tropicalis]" Bethesda (MD): National Library of Medicine (US), National Center for Biotechnology Information [online]. Retrieved from: https://www.ncbi.nlm.nih.gov/protein/BAF82026, 1 page.
GenPept Accession No. NP_689808.2 (May 2, 2019) "piggyBac transposable element-derived protein 4 [*Homo sapiens*]" Bethesda (MD): National Library of Medicine (US), National Center for Biotechnology Information [online]. Retrieved from: https://www.ncbi.nlm.nih.gov/protein/NP_689808, 2 pages.
GenPept Accession No. NP_741958.1 (Mar. 29, 2020) "piggyBac transposable element-derived protein 5 [Mus musculus]" Bethesda (MD): National Library of Medicine (US), National Center for Biotechnology Information [online]. Retrieved from: https://www.ncbi.nlm.nih.gov/protein/NP_741958, 2 pages.
GenPept Accession No. XP_001814566.1 (Jul. 21, 2008) "Predicted: similar to PiggyBac transposable element-derived protein 4 [Tribolium castaneum]" Bethesda (MD): National Library of Medicine (US), National Center for Biotechnology Information [online]. Retrieved from: https://www.ncbi.nlm.nih.gov/protein/XP_001814566.1?report=genpept, 1 page.
GenPept Accession No. XP_001948139.1 (Jul. 2, 2008) "Predicted: similar to Piggy Bac transposable element-derived protein 4 [Acyrthosiphon pisum]" Bethesda (MD): National Library of Medicine (US), National Center for Biotechnology Information [online]. Retrieved from: https://www.ncbi.nlm.nih.gov/protein/XP_001948139.1?report=genpept, 1 page.
GenPept Accession No. XP_002123602.1 (Oct. 24, 2014) "Predicted: piggyBac transposable element-derived protein 4-like [Ciona intestinalis]" Bethesda (MD): National Library of Medicine (US), National Center for Biotechnology Information [online]. Retrieved from: https://www.ncbi.nlm.nih.gov/protein/XP_002123602.1?report=genpept, 2 pages.
GenPept Accession No. XP_220453.3 (Apr. 15, 2005) "Predicted: similar to piggyBac transposable element derived 2 [Rattus norvegicus]" Bethesda (MD): National Library of Medicine (US), National Center for Biotechnology Information [online]. Retrieved from: https://www.ncbi.nlm.nih.gov/protein/XP_220453.3?report=genpept, 1 page.
GenPept Accession No. XP_310729.1 (Apr. 26, 2018) "AGAP000379-PA [Anopheles gambiae str. PEST]" Bethesda (MD): National Library of Medicine (US), National Center for Biotechnology Information [online]. Retrieved from: https://www.ncbi.nlm.nih.gov/protein/XP_310729, 2 pages.
GenPept Accession No. XP_312615.1 (Apr. 26, 2018) "AGAP002349-PA [Anopheles gambiae str. PEST]" Bethesda (MD): National Library of Medicine (US), National Center for Biotechnology Information [online]. Retrieved from: https://www.ncbi.nlm.nih.gov/protein/XP_312615, 2 pages.
GenPept Accession No. XP_320414.1 (Apr. 2, 20186) "AGAP012114-PA [Anopheles gambiae str. PEST]" Bethesda (MD): National Library of Medicine (US), National Center for Biotechnology Information [online]. Retrieved from: https://www.ncbi.nlm.nih.gov/protein/XP_320414, 2 pages.
Gossen, M. and H. Bujard (Jun. 1992) "Tight control of gene expression in mammalian cells by tetracycline-responsive promoters" Proc Natl Acad Sci USA, 89:5547-5551.
Gossen, M. et al. (Jun. 23, 1995) "Transcriptional activation by tetracyclkines in mammalian cells" Science, 268(5218):1766-1769.
Irving, M. et al. (Apr. 3, 2017) "Engineering Chimeric Antigen Receptor T-Cells for Racing in Solid Tumors: Don't Forget the Fuel" Frontiers in Immunology, 8:267, 19 pages.
Iuliucci, J.D. et al. (2001) "Intravenous Safety and Pharmacokinetics of a Novel Dimerizer Drug, AP1903, in Healthy Volunteers" J Clin Pharmacol, 41:870-879.
Jena, B. et al. (Aug. 19, 2010) "Redirecting T-cell specificity by introducing a tumor-specific chimeric antigen receptor" Blood, 116(7):1035-1044.
Junginger, H.E. et al. (1994) "Visualization of Drug Transport Across Human Skin and the Influence of Penetration Enhancers" in Drug Permeation Enhancement. Hsieh, D.S. (Ed.); New York: Marcel Dekker, Inc., pp. 59-89.
Kageyama, R. et al. (Feb. 1, 19875) "Differing Utilization of Homologous Transcription Initiation Sites of Rat K and T Kininogen Genes Under Inflammation Condition" J Biol Chem, 262(5):2345-2351.
Maus, M. V. et al. (Apr. 2, 20144) "Antibody-modified T cells: CARs take the front seat for hematologic malignancies" Blood, 123(17):2625-2635.
Myers, D.R. et al. (2017) "Tonic Signals: Why do Lymphocytes Bother?" Trends in Immunology, Article in Press [online]. Retrieved from: http://dx.doi.org/10.1016/j.it.2017.06.010, 14 pages.
Oliviero, S. et al. (1987) "The human haptoglobin gene: transcriptional regulation during development and acute phase induction" The EMBO Journal, 6(7):1905-1912.
Philip, B et al. (Aug. 21, 2014) "A highly compact epitope-based marker/suicide gene for easier and safer T-cell therapy" Blood, 124(8):1277-1287.
Poli, V. and R. Cortese (Nov. 1989) "Interleukin 6 induces a liver-specific nuclear protein that binds to the promoter of acute-phase genes" Proc Natl Acad Sci USA, 86:8202-8206.
Prowse, K.R. and H. Baumann (Jan. 1988) "Hepatocyte-Stimulating Factor, β2 Interferon, and Interleukin-1 Enhance Expression of the Rat α1-Acid Glycoprotein Gene via a Distal Upstream Regulatory Region" Mol Cell Biol, 8(1):42-51.
Quntarelli, C et al. (Oct. 15, 2007) "Co-expression of cytokine and suicide genes to enhance the activity and safety of tumor-specific

(56) References Cited

OTHER PUBLICATIONS cytotoxic T lymphocytes" Blood, 110(8):2793-2802 [online]. Retrieved from the Internet: www.ncbi.nlm.nih.gov/pmc/articles/PMC2018664/?report=printable; retrieved on Apr. 1, 2019, 22 printed pages.

Smith, L.J. et al. (1992) "Human Interleukin 4. The Solution Structure of a Four-helix Bundle Protein" J Mol Biol, 244:899-904.

Sprague, J. et al. (Feb. 1983) "Expression of a Recombinant DNA Gene Coding for the Vesicular Stomatitis Virus Nucleocapsid Protein" J Virol, 45(2):773-781.

Straathof, K.C. et al. (2005) "An inducible caspase 9 safety switch for T-cell therapy" Blood, 105:4247-4254.

Uchibori, R. et al. (May 1, 2014) "Development of inducible switch promoters that drive exogenous gene expression upon the recognition of CD19 by chimeric antiven receptors" Molecular Therapy, 22(Suppl 1):S165-S166, Abstract 432.

Vilaboa, N. et al. (Jan. 1, 2011) "Gene Switches for Deliberate Regulation of Transgene Expression: Recent Advances in System Development and Uses", J Genet Syndr Gene Ther, 2(3):1000107; DOI: 10.4172/2157-7412.1000107, 23 pages.

Wilson, D.R. et al. (Dec. 1990) "A 58-Base-Pair Region of the Human C3 Gene Confers Synergistic Inducibility by Interleukin-1 and Interleukin-6" Mol Cell Biol, 10(12):6181-6191.

Wu, C-Y. et al. (Oct. 16, 2015) "Remote control of therapeutic T cells through a small molecule-gated chimeric receptor" Science, 350(6258); DOI: 10.1126/science.aab4077, 10 pages, with Summary, p. 293.

Zechner, R. et al. (Jun. 1988) "Recombinant Human Cachectin/Tumor Necrosis Factor but Not Interleukin-1α Downregulates Lipoprotein Lipase Gene Expression at the Transcriptional Level in Mouse 3T3-L1 Adipocytes" Mol Cell Biol, 8(6):2394-2401.

Li, Haiying et al. "Modern Molecular Biology and Genetic Engineering" General Higher Education "Eleventh Five-Year Plan", Beijing: Chemical Industry Press (2008); p. 95, in Chinese only, 3 pages, ISBN 978-7-122-01794-9.

Luo, Senlin et al. "Bioinformation Processing Techniques and Methods" Beijing: Beijing Institute of Technology Press (2015); p. 300, in Chinese only, 16 pages.

Office Action for Chinese Application No. 201880071587.1 mailed Sep. 30, 2024, 15 pages.

\* cited by examiner

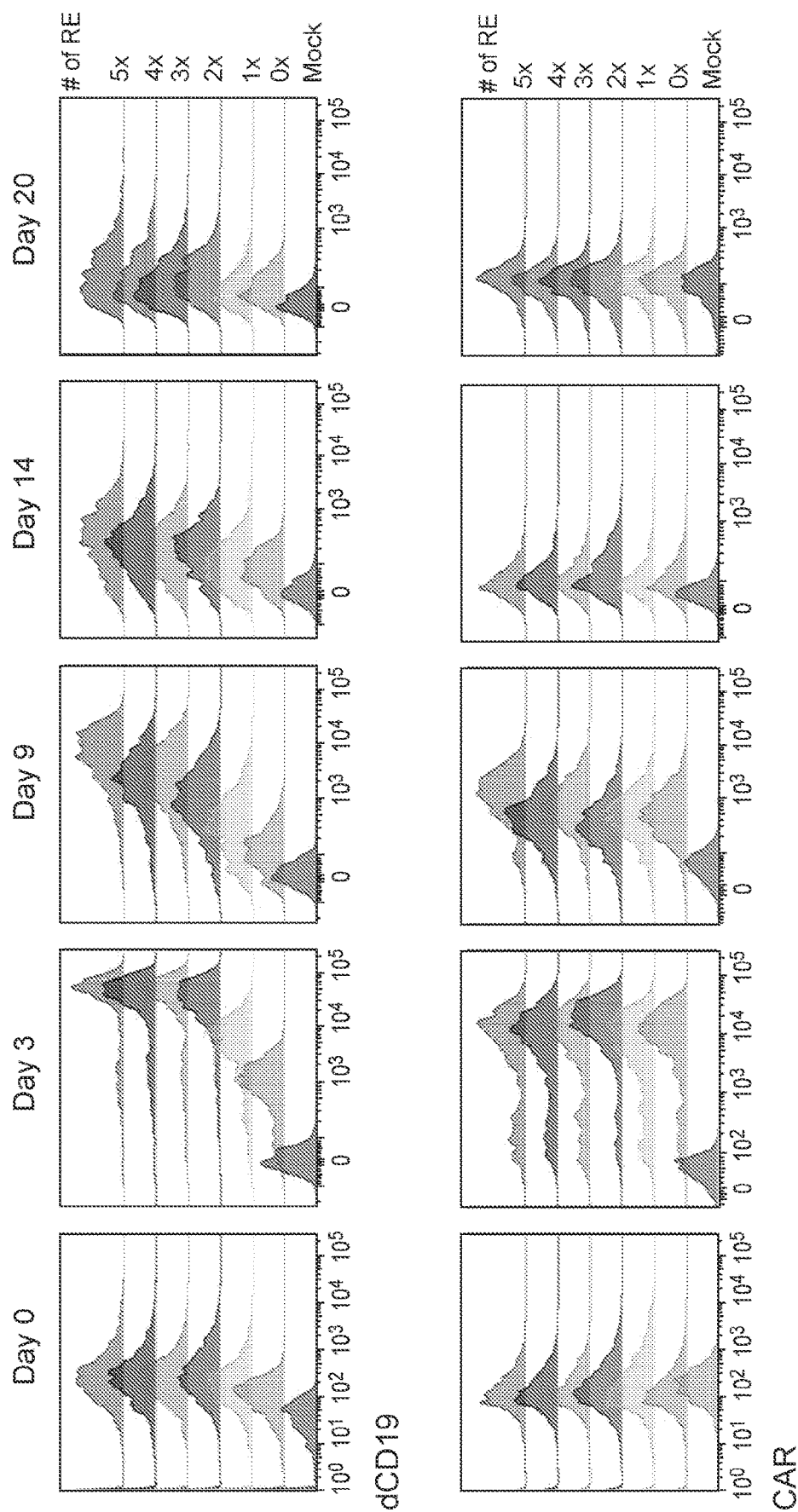

Cas-Clover mRNA Comparison Embodiment 1 v. Embodiment 2

COMPOSITIONS AND METHODS FOR CHIMERIC LIGAND RECEPTOR (CLR)-MEDIATED CONDITIONAL GENE EXPRESSION

CROSS-REFERENCE TO RELATED APPLICATIONS

This application is a U.S. National Phase Application, filed under 35 U.S.C. § 371 of International Patent Application No. PCT/2018/050288, filed Sep. 10, 2018, which claims the benefit of provisional application U.S. Ser. No. 62/556,310, filed Sep. 8, 2017. The contents of each of these applications are herein incorporated by reference in their entirety.

INCORPORATION OF SEQUENCE LISTING

The contents of the text file named "POTH-027-N01US_SequenceListing_R.txt" which was created on Jan. 11, 2021 and is 55,448 KB in size, are hereby incorporated by reference it their entirety.

FIELD OF THE DISCLOSURE

The disclosure is directed to molecular biology, and more, specifically, to compositions and methods for use in a conditional gene expression system responsive to a chimeric ligand receptor (CLR)-mediated signal.

BACKGROUND

There has been a long-felt but unmet need in the art for a method of controlling gene expression in genetically modified cells for the long-term delivery of therapeutic agents. The disclosure provides a solution by genetically modified cells that conditionally express genes upon activation of a cell-surface receptor.

SUMMARY

The disclosure provides a composition comprising (a) an inducible transgene construct, comprising a sequence encoding an inducible promoter and a sequence encoding a transgene, and (b) a receptor construct, comprising a sequence encoding a constitutive promoter and a sequence encoding an exogenous receptor, wherein, upon integration of the construct of (a) and the construct of (b) into a genomic sequence of a cell, the exogenous reporter is expressed, and wherein the exogenous reporter, upon binding a ligand, transduces an intracellular signal that targets the inducible promoter of (a) to modify gene expression. In certain embodiments, the composition modifies gene expression by increasing gene expression. In certain embodiments, the composition modifies gene expression by decreasing gene expression. In certain embodiments, the composition modifies gene expression by transiently modifying gene expression (e.g. for the duration of binding of the ligand to the exogenous receptor). In certain embodiments, the composition modifies gene expression acutely (e.g. the ligand reversibly binds to the exogenous receptor). In certain embodiments, the composition modifies gene expression chronically (e.g. the ligand irreversibly binds to the exogenous receptor).

In certain embodiments of the compositions of the disclosure, the cell may be a prokaryotic cell. Prokaryotic cells of the disclosure include, but are not limited to, bacteria and archaea. For example, bacteria of the disclosure include, but are not limited to, *Listeria monocytogenes*.

In certain embodiments of the compositions of the disclosure, the cell may be a eukaryotic cell. Eukaryotic cells of the disclosure include, but are not limited to, yeast, plants, algae, insects, mammals, amphibians, birds, reptiles, marsupials, rodents, and humans. Preferred eukaryotic cells of the disclosure include, but are not limited to, human cells. Exemplary human cells of the disclosure include but are not limited to, immune cells (e.g. T cells), myeloid cells and bone marrow cells (e.g. hematopoietic stem cells (HSCs)).

In certain embodiments of the compositions of the disclosure, the exogenous receptor of (b) comprises an endogenous receptor with respect to the genomic sequence of the cell. Exemplary receptors include, but are not limited to, intracellular receptors, cell-surface receptors, transmembrane receptors, ligand-gated ion channels, and G-protein coupled receptors.

In certain embodiments of the compositions of the disclosure, the exogenous receptor of (b) comprises a non-naturally occurring receptor. In certain embodiments, the non-naturally occurring receptor is a synthetic, modified, recombinant, mutant or chimeric receptor. In certain embodiments, the non-naturally occurring receptor comprises one or more sequences isolated or derived from a T-cell receptor (TCR). In certain embodiments, the non-naturally occurring receptor comprises one or more sequences isolated or derived from a scaffold protein. In certain embodiments, including those wherein the non-naturally occurring receptor does not comprise a transmembrane domain, the non-naturally occurring receptor interacts with a second transmembrane, membrane-bound and/or an intracellular receptor that, following contact with the non-naturally occurring receptor, transduces an intracellular signal.

In certain embodiments of the compositions of the disclosure, the exogenous receptor of (b) comprises a non-naturally occurring receptor. In certain embodiments, the non-naturally occurring receptor is a synthetic, modified, recombinant, mutant or chimeric receptor. In certain embodiments, the non-naturally occurring receptor comprises one or more sequences isolated or derived from a T-cell receptor (TCR). In certain embodiments, the non-naturally occurring receptor comprises one or more sequences isolated or derived from a scaffold protein. In certain embodiments, the non-naturally occurring receptor comprises a transmembrane domain. In certain embodiments, the non-naturally occurring receptor interacts with an intracellular receptor that transduces an intracellular signal. In certain embodiments, the non-naturally occurring receptor comprises an intracellular signalling domain. In certain embodiments, the non-naturally occurring receptor is a chimeric ligand receptor (CLR). In certain embodiments, the CLR is a chimeric antigen receptor.

In certain embodiments of the compositions of the disclosure, the exogenous receptor of (b) comprises a non-naturally occurring receptor. In certain embodiments, the CLR is a chimeric antigen receptor. In certain embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In certain embodiments, the ectodomain of (a) further comprises a signal peptide. In certain embodiments, the ectodomain of (a) further comprises a hinge between the ligand recognition region and the transmembrane domain. In certain embodiments, the signal peptide comprises a sequence encoding a human CD2, CD3δ, CD3ε, CD3γ, CD3ζ, CD4, CD8α, CD19, CD28, 4-1BB or GM-CSFR signal peptide. In certain embodiments, the signal peptide comprises a sequence encoding a human CD8a signal peptide. In certain embodiments, the signal peptide comprises an amino acid sequence comprising MALPVTALLLPLALLLHAARP (SEQ ID NO:17000). In certain embodiments, the signal peptide is encoded by a nucleic acid sequence comprising aggcactgccagtcaccgccctgctgctgcctctggctctgctgctgcacgcagctagacca (SEQ ID NO:17001). In certain embodiments, the transmembrane domain comprises a sequence encoding a human CD2, CD3δ, CD3ε, CD3γ, CD3ζ, CD4, CD8α, CD19, CD28, 4-1BB or GM-CSFR transmembrane domain. In certain embodiments, the transmembrane domain comprises a sequence encoding a human CD8α transmembrane domain. In certain embodiments, the transmembrane domain comprises an amino acid sequence comprising IYIWAPLAGTCGVLLLSLVITLYC (SEQ ID NO: 17002). In certain embodiments, the transmembrane domain is encoded by a nucleic acid sequence comprising atctacatttgggcaccactggccgggacctgtggagtgctgctgctgagcctggtcatcacactgtactgc (SEQ ID NO: 17003). In certain embodiments, the endodomain comprises a human CD3ζ endodomain. In certain embodiments, the at least one costimulatory domain comprises a human 4-1BB, CD28, CD3ζ, CD40, ICOS, MyD88, OX-40 intracellular segment, or any combination thereof. In certain embodiments, the at least one costimulatory domain comprises a human CD3ζ and/or a 4-1BB costimulatory domain. In certain embodiments, the CD3ζ costimulatory domain comprises an amino acid sequence comprising RVKFSRSADAPAYKQGQNQLYNELNLGRREEYDVLDKRRGRDPEMGGKPRRKNPQ EGLYNELQKDKMAEAYSEIGMKGERRRGKGHDGLYQGLSTATKDTYDALHMQALP PR (SEQ ID NO: 17004). In certain embodiments, the CD3 costimulatory domain is encoded by a nucleic acid sequence comprising cgcgtgaagtttagtcgatcagcagatgccccagctta-caaacagggacagaaccagctgtataacgagctgaatcgggccgccga gaggaatatgacgtgctggataagcggagaggacgcgaccccgaaatgggaggcaagcccaggcgcaaaaaccctcaggaagg cctgtataacgagctgcagaaggacaaaatggcagaagcctattctgagatcggcatgaaggggggagcgacggagaggcaaagg gcacgatgggctgtaccagggactgagcaccgccacaaaggacacctatgatgctctgcatatgcaggcactgcctccaagg (SEQ ID NO: 17005). In certain embodiments, the 4-1BB costimulatory domain comprises an amino acid sequence comprising KRGRKKLLYIFKQPFMRPVQTTQEEDGCSCRFPEEEEGGCEL (SEQ ID NO: 17006). In certain embodiments, the 4-1BB costimulatory domain is encoded by a nucleic acid sequence comprising aagagaggcaggaagaaactgctgtatattttcaaacagcccttcatgcgccccgtgcagactacccaggaggaagacgggtgctcc tgtcgattccctgaggaagaggaaggcgggtgtgagctg (SEQ ID NO: 17007). In certain embodiments, the 4-1BB costimulatory domain is located between the transmembrane domain and the CD3ζ costimulatory domain. In certain embodiments, the hinge comprises a sequence derived from a human CD8α, IgG4, and/or CD4 sequence. In certain embodiments, the hinge comprises a sequence derived from a human CD8α sequence. In certain embodiments, the hinge comprises an amino acid sequence comprising

TTTPAPRPPTPAPTIASQPLSLRPEACRPAAGGAVHTRGLDFACD. (SEQ ID NO: 17008)

In certain embodiments, the hinge is encoded by a nucleic acid sequence comprising actaccacaccagcacctagaccaccaactccagctccaacatcgcgagtcagcccctgagtctgagacctgaggcctgcaggcc agctgcaggaggagctgtgcacaccaggggcctggacttcgcctgcgac (SEQ ID NO: 17028). In certain embodiments, the hinge is encoded by a nucleic acid sequence comprising ACCACAACCCCTGCCCCCAGACCTCCCACACCCGCCCCTACCATCGCGAGTCAGC CCCTGAGTCTGAGACCTGAGGCCTGCAGGCCAGCTGCAGGAGGAGCTGTGCACA CCAGGGGCCTGGACTTCGCCTGCGAC (SEQ ID NO: 17009). In certain embodiments, the at least one protein scaffold specifically binds the ligand.

In certain embodiments of the compositions of the disclosure, the exogenous receptor of (b) comprises a non-naturally occurring receptor. In certain embodiments, the CLR is a chimeric antigen receptor. In certain embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In certain embodiments, the at least one protein scaffold comprises an antibody, an antibody fragment, a single domain antibody, a single chain antibody, an antibody mimetic, or a Centyrin. In certain embodiments, the ligand recognition region comprises one or more of an antibody, an antibody fragment, a single domain antibody, a single chain antibody, an antibody mimetic, and a Centyrin. In certain embodiments, the single domain antibody comprises or consists of a VHH. In certain embodiments, the antibody mimetic comprises or consists of an affibody, an affilin, an affimer, an affitin, an alphabody, an anticalin, an avimer, a DARPin, a Fynomer, a Kunitz domain peptide or a monobody. In certain embodiments, the Centyrin comprises or consists of a consensus sequence of at least one fibronectin type III (FN3) domain.

In certain embodiments of the compositions of the disclosure, the exogenous receptor of (b) comprises a non-naturally occurring receptor. In certain embodiments, the CLR is a chimeric antigen receptor. In certain embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In certain embodiments, the Centyrin comprises or consists of a consensus sequence of at least one fibronectin type III (FN3) domain. In certain embodiments, the at least one fibronectin type III (FN3) domain is derived from a human protein. In certain embodiments, the human protein is Tenascin-C. In certain embodiments, the consensus sequence comprises LPAPKNLVVSEVTEDSLRLSWTAPDAAFDSFLIQYQESEKVGEAINLTVPGSERSYDL TGLKPGTEYTVSIYGVKGGHRSNPLSAEFTT (SEQ ID NO: 17010). In certain embodiments, the consensus sequence comprises MLPAPKNLVVSEVTEDSLRLSWTAPDAAFDSFLIQYQESEKVGEAINLTVPGSERSYD LTGLKPGTEYTVSIYGVKGGHRSNPLSAEFTT (SEQ ID NO: 17011). In certain embodiments, the consensus sequence is modified at one or more positions within (a) a A-B loop comprising or consisting of the amino acid residues TEDS at positions 13-16 of the consensus sequence; (b) a B-C loop comprising or consisting of the amino acid residues TAPDAAF at positions 22-28 of the consensus sequence; (c) a C-D loop comprising or consisting of the amino acid residues SEKVGE at positions 38-43 of the consensus sequence; (d) a D-E loop comprising or consisting of the amino acid residues GSER at positions 51-54 of the consensus sequence; (e) a E-F loop comprising or consisting of the amino acid residues GLKPG at positions 60-64 of the consensus sequence; (f) a F-G loop comprising or consisting of the amino acid residues KGGHRSN at positions 75-81 of the consensus sequence; or (g) any combination of (a)-(f). In certain embodiments, the Centyrin comprises a consensus sequence of at least 5 fibronectin type IT (FN3) domains. In certain embodiments, the Centyrin comprises a consensus sequence of at least 10 fibronectin type III (FN3) domains. In certain embodiments, the Centyrin comprises a consensus sequence of at least 15 fibronectin type III (FN3) domains. In certain embodiments, the scaffold binds an antigen with at least one affinity selected from a $K_D$ of less than or equal to $10^{-9}$ M, less than or equal to $10^{-10}$ M, less than or equal to $10^{-1}$ M, less than or equal to $10^{-12}$ M, less than or equal to $10^{-13}$ M, less than or equal to $10^{-14}$ M, and less than or equal to $10^{-15}$ M. In certain embodiments, the $K_D$ is determined by surface plasmon resonance. In certain embodiments of the compositions of the disclosure, the exogenous receptor of (b) comprises a non-naturally occurring receptor. In certain embodiments, the CLR is a chimeric antigen receptor. In certain embodiments, the chimeric ligand receptor comprises (a) an ectodomain comprising a ligand recognition region, wherein the ligand recognition region comprises at least a VHH antibody; (b) a transmembrane domain, and (c) an endodomain comprising at least one costimulatory domain. In certain embodiments, the VHH is camelid. Alternatively, or in addition, in certain embodiments, the VHH is humanized. In certain embodiments, the sequence comprises two heavy chain variable regions of an antibody, wherein the complementarity-determining regions (CDRs) of the VHH are human sequences.

In certain embodiments of the compositions of the disclosure, the sequence encoding the constitutive promoter of (b) comprises a sequence encoding an EF1α promoter. In certain embodiments of the compositions of the disclosure, the sequence encoding the constitutive promoter of (b) comprises a sequence encoding a CMV promoter, a U6 promoter, a SV40 promoter, a PGK1 promoter, a Ubc promoter, a human beta actin promoter, a CAG promoter, or an EF1α promoter.

In certain embodiments of the compositions of the disclosure, the sequence encoding the inducible promoter of (a) comprises a sequence encoding an NFκB promoter. In certain embodiments of the compositions of the disclosure, the sequence encoding the inducible promoter of (a) comprises a sequence encoding an interferon (IFN) promoter or a sequence encoding an interleukin-2 promoter. In certain embodiments of the compositions of the disclosure, the sequence encoding the inducible promoter of (a) comprises a sequence encoding a nuclear receptor subfamily 4 group A member 1 (NR4A1; also known as NUR77) promoter or a sequence encoding a NR4A1 promoter. In certain embodiments of the compositions of the disclosure, the sequence encoding the inducible promoter of (a) comprises a sequence encoding a T-cell surface glycoprotein CD5 (CD5) promoter or a sequence encoding a CD5 promoter. In certain embodiments, the interferon (IFN) promoter is an IFNγ promoter. In certain embodiments of the compositions of the disclosure, the inducible promoter is isolated or derived from the promoter of a cytokine or a chemokine. In certain embodiments, the cytokine or chemokine comprises IL2, IL3, IL4, IL5, IL6, IL10, IL12, IL13, IL17A/F, IL21, IL22, IL23, transforming growth factor beta (TGFβ), colony stimulating factor 2 (GM-CSF), interferon gamma (IFNγ), Tumor necrosis factor (TNFα), LTα, perforin, Granzyme C (Gzmc), Granzyme B (Gzmb), C-C motif chemokine ligand 5 (CCL5), C-C motif chemokine ligand 4 (CCL4). C-C motif chemokine ligand 3 (CCL3), X-C motif chemokine ligand 1 (XCL1) and LIF interleukin 6 family cytokine (Lif).

In certain embodiments of the compositions of the disclosure, including those wherein the sequence encoding the inducible promoter of (a) comprises a sequence encoding a NR4A1 promoter or a sequence encoding a NR4A1 promoter, the NR4A1 promoter is activated by T-cell Receptor (TCR) stimulation in T cells and by B-cell Receptor (BCR) stimulation in B cells, therefore, inducing expression of any sequence under control of the NR4A1 promoter upon activation of a T-cell or B-cell of the disclosure through a TCR or BCR, respectively.

In certain embodiments of the compositions of the disclosure, including those wherein the sequence encoding the inducible promoter of (a) comprises a sequence encoding a CD5 promoter or a sequence encoding a CD5 promoter, the CD5 promoter is activated by T-cell Receptor (TCR) stimulation in T cells, therefore, inducing expression of any sequence under control of the CD5 promoter upon activation of a T-cell of the disclosure through a TCR.

In certain embodiments of the compositions of the disclosure, the inducible promoter is isolated or derived from the promoter of a gene comprising a surface protein involved in cell differention, activation, exhaustion and function. In certain embodiments, the gene comprises CD69, CD71, CTLA4, PD-1, TIGIT, LAG3, TIM-3, GITR, MHCII, COX-2, FASL and 4-1BB.

In certain embodiments of the compositions of the disclosure, the inducible promoter is isolated or derived from the promoter of a gene involved in CD metabolism and differentiation. In certain embodiments of the compositions of the disclosure, the inducible promoter is isolated or derived from the promoter of Nr4a1, Nr4a3, Tnfrsf9 (4-1BB), Sema7a, Zfp3612, Gadd45b, Dusp5, Dusp6 and Neto2.

In certain embodiments of the compositions of the disclosure, the transgene comprises a sequence that is endogenous with respect to the genomic sequence of the cell.

In certain embodiments of the compositions of the disclosure, the transgene comprises a sequence that is exogenous with respect to the genomic sequence of the cell. In certain embodiments, the exogenous sequence is a sequence variant of an endogenous sequence within the genome of the cell. In certain embodiments, the exogenous sequence is a wild type sequence of gene that is entirely or partially absent in the cell, and wherein the gene is entirely present in the genome of a healthy cell. In certain embodiments, the exogenous sequence is a synthetic, modified, recombinant, chimeric or non-naturally occurring sequence with respect to the genome of the cell. In certain embodiments, the transgene encodes a secreted protein. In certain embodiments, the secreted protein is produced and/or secreted from the cell at a level that is therapeutically effective to treat a disease or disorder in a subject in need thereof.

In certain embodiments of the compositions of the disclosure, a first transposon comprises the inducible transgene construct of (a) and a second transposon comprises the receptor construct of (b). In certain embodiments of the compositions of the disclosure, a first vector comprises the first transposon and a second vector comprises the second transposon. In certain embodiments of the compositions of the disclosure, a vector comprises the first transposon and the second transposon. In certain embodiments, the first transposon and the second transposon are oriented in the same direction. In certain embodiments, the first transposon and the second transposon are oriented in opposite directions. In certain embodiments, the vector is a plasmid. In certain embodiments, the vector is a nanoplasmid.

In certain embodiments of the compositions of the disclosure, the vector is a viral vector. Viral vectors of the disclosure may comprise a sequence isolated or derived from a retrovirus, a lentivirus, an adenovirus, an adeno-associated virus or any combination thereof. The viral vector may comprise a sequence isolated or derived from an adeno-associated virus (AAV). The viral vector may comprise a recombinant AAV (rAAV). Exemplary adeno-associated viruses and recombinant adeno-associated viruses of the disclosure comprise two or more inverted terminal repeat (ITR) sequences located in cis next to a sequence encoding a construct of the disclosure. Exemplary adeno-associated viruses and recombinant adeno-associated viruses of the disclosure include, but are not limited to all serotypes (e.g. AAV1, AAV2, AAV3, AAV4. AAV5, AAV6, AAV7, AAV8, and AAV9). Exemplary adeno-associated viruses and recombinant adeno-associated viruses of the disclosure include, but are not limited to, self-complementary AAV (scAAV) and AAV hybrids containing the genome of one serotype and the capsid of another serotype (e.g. AAV2/5, AAV-DJ and AAV-DJ8). Exemplary adeno-associated viruses and recombinant adeno-associated viruses of the disclosure include, but are not limited to, rAAV-LK03 and AAVs with the NP-59 and NP-84 capsid variants.

In certain embodiments of the compositions of the disclosure, the vector is a nanoparticle. Exemplary nanoparticle vectors of the disclosure include, but are not limited to, nucleic acids (e.g. RNA, DNA, synthetic nucleotides, modified nucleotides or any combination thereof), amino acids (L-amino acids, D-amino acids, synthetic amino acids, modified amino acids, or any combination thereof), polymers (e.g. polymersomes), micelles, lipids (e.g. liposomes), organic molecules (e.g. carbon atoms, sheets, fibers, tubes), inorganic molecules (e.g. calcium phosphate or gold) or any combination thereof. A nanoparticle vector may be passively or actively transported across a cell membrane.

In certain embodiments of the compositions of the disclosure, first transposon or the second transposon is a piggyBac transposon. In certain embodiments, the first transposon and the second transposon is a piggyBac transposon. In certain embodiments, the composition further comprises a plasmid or a nanoplasmid comprising a sequence encoding a transposase enzyme. In certain embodiments, the sequence encoding a transposase enzyme is an mRNA sequence. In certain embodiments, the transposase is a piggyBac transposase. In certain embodiments, the piggyBac transposase comprises an amino acid sequence comprising SEQ ID NO: 1. In certain embodiments, the piggyBac transposase is a hyperactive variant and wherein the hyperactive variant comprises an amino acid substitution at one or more of positions 30, 165, 282 and 538 of SEQ ID NO: 1. In certain embodiments, the amino acid substitution at position 30 of SEQ ID NO: 1 is a substitution of a valine (V) for an isoleucine (I) (I30V). In certain embodiments, the amino acid substitution at position 165 of SEQ ID NO: 1 is a substitution of a serine (S) for a glycine (G) (G165S). In certain embodiments, the amino acid substitution at position 282 of SEQ ID NO: 1 is a substitution of a valine (V) for a methionine (M) (M282V). In certain embodiments, the amino acid substitution at position 538 of SEQ ID NO: 1 is a substitution of a lysine (K) for an asparagine (N) (N538K). In certain embodiments, the transposase is a Super piggyBac (SPB) transposase. In certain embodiments, the Super piggyBac (SPB) transposase comprises an amino acid sequence comprising SEQ ID NO: 2.

In certain embodiments of the disclosure, the transposase enzyme is a piggyBac™ (PB) transposase enzyme. The piggyBac (PB) transposase enzyme may comprise or consist of an amino acid sequence at least 75%, 80%, 85%, 90%, 95%, 99% or any percentage in between identical to:

```
                                            (SEQ ID NO: 17029)
  1 MGSSLDDEHI LSALLQSDDE LVGEDSDSEI SDHVSEDDVQ
    SDTEEAFIDE VHEVQPTSSG

61 SEILDEQNVI EQPGSSLASN RILTLPQRTI RGKNKHCWST
    SKSTRRSRVS ALNIVRSQRG

121 PTRMCRNIYD PLDCFKLFFT DEIISEIVKW TNAEISLKRR
    ESMTGATFRD TNEDEIYAFF

181 GILVMTAVRK DNHMSTDDLF DRSLSMVYVS VMSRDRFDFL
    IRCLRMDDKS IRPTLRENDV

241 FTPVRKIWDL FIHQCIQNYT PQAHLTIDEQ LLGFRQRQPF
    RMYIPNKPSK YQIKILMMCD

301 SGYKYMINGM PYLGRGTQTN GVRLGEYYVK ELSKPVHGSC
    RNITCDNWFT SIPLAKNLLQ

361 EPYKLTIVGT VRSNKREIPE VLKNSRSRPV GTSMFCFDGP
    LTLVSYKPKP AKMVYLLSSC

421 DEDASINEST GKPQMVMYYN QTKGGVDTLD QMCSVMTCSR
    KTNRWRMALL YGMINIACIN

481 SFIIYSHNVS SKGEKVQSRK KFMRNLYMSL TSSFMRKRLE
    APTLKRYLRD NISNILPNEV

541 PGTSDDSTEE PVMKKRTYCT YCPSKIRRKA NASCKKCKKV
    ICREHNIDMC QSCF.
```

In certain embodiments of the disclosure, the transposase enzyme is a piggyBac™ (PB) transposase enzyme that comprises or consists of an amino acid sequence having an amino acid substitution at one or more of positions 30, 165, 282, or 538 of the sequence:

```
                                            (SEQ ID NO: 17029)
  1 MGSSLDDEHI LSALLQSDDE LVGEDSDSEI SDHVSEDDVQ
    SDTEEAFIDE VHEVQPTSSG

61 SEILDEQNVI EQPGSSLASN RILTLPQRTI RGKNKHCWST
    SKSTRRSRVS ALNIVRSQRG

121 PTRMCRNIYD PLLCFKLFFT DEIISEIVKW TNAEISLKRR
    ESMTGATFRD TNEDEIYAFF

181 GILVMTAVRK DNHMSTDDLF DRSLSMVYVS VMSRDRFDFL
    IRCLRMDDKS IRPTLRENDV

241 FTPVRKIWDL FIHQCIQNYT PGAHLTIDEQ LLGFRGRCPF
    RMYIPNKPSK YGIKILMMCD

301 SGYKYMINGM PYLGRGTQTN GVPLGEYYVK ELSKPVHGSC
    RNITCDNWFT SIPLAKNLLQ

361 EPYKLTIVGT VRSNKREIPE VLKNSRSRPV GTSMFCFDGP
    LTLVSYKPKP AKMVYLLSSC

421 DEDASINEST GKPQMVMYYN QTKGGVDTLD QMCSVMTCSR
    KTNRWPMALL YGMINIACIN

481 SFIIYSHNVS SKGEKVQSRK KFMRNLYMSL TSSFMRKRLE
    APTLKRYLRD NISNILPNEV

541 PGTSDDSTEE PVMKKRTYCT YCPSKIRRKA NASCKKCKKV
    ICREHNIDMC QSCF.
```

In certain embodiments, the transposase enzyme is a piggyBac™ (PB) transposase enzyme that comprises or consists of an amino acid sequence having an amino acid substitution at two or more of positions 30, 165, 282, or 538 of the sequence of SEQ ID NO: 1. In certain embodiments, the transposase enzyme is a piggyBac™ (PB) transposase enzyme that comprises or consists of an amino acid sequence having an amino acid substitution at three or more of positions 30, 165, 282, or 538 of the sequence of SEQ ID NO: 1. In certain embodiments, the transposase enzyme is a piggyBac™ (PB) transposase enzyme that comprises or consists of an amino acid sequence having an amino acid substitution at each of the following positions 30, 165, 282, and 538 of the sequence of SEQ ID NO: 1. In certain embodiments, the amino acid substitution at position 30 of the sequence of SEQ ID NO: 1 is a substitution of a valine (V) for an isoleucine (1). In certain embodiments, the amino acid substitution at position 165 of the sequence of SEQ ID NO: 1 is a substitution of a serine (S) for a glycine (G). In certain embodiments, the amino acid substitution at position 282 of the sequence of SEQ ID NO: 1 is a substitution of a valine (V) for a methionine (M). In certain embodiments, the amino acid substitution at position 538 of the sequence of SEQ ID NO: 1 is a substitution of a lysine (K) for an asparagine (N).

In certain embodiments of the disclosure, the transposase enzyme is a Super piggyBac™ (SPB) transposase enzyme. In certain embodiments, the Super piggyBac™ (SPB) transposase enzymes of the disclosure may comprise or consist of the amino acid sequence of the sequence of SEQ ID NO: 1 wherein the amino acid substitution at position 30 is a substitution of a valine (V) for an isoleucine (I), the amino acid substitution at position 165 is a substitution of a serine (S) for a glycine (G), the amino acid substitution at position 282 is a substitution of a valine (V) for a methionine (M), and the amino acid substitution at position 538 is a substitution of a lysine (K) for an asparagine (N). In certain embodiments, the Super piggyBac™ (SPB) transposase enzyme may comprise or consist of an amino acid sequence at least 75%, 80%, 85%, 90%, 95%, 99% or any percentage in between identical to:

```
                                      (SEQ ID NO: 17030)
  1 MGSSLDDEHI LSALLQSDDE LVGEDSDSEV SDHVSEDDVQ
    SDTEEAFIDE VHEVQPTSSG

61 SEILDEQNVI EQPGSSLASN RILTLPQRTI RGKNKHCWST
    SKSTRRSRVS ALNIVRSQRG

121 PTRMCRNIYD PLLCFKLFFT DEIISEIVKW TNAEISLKRR
    ESMTSATFRD TNEDEIYAFF

181 GILVMTAVRK DNHMSTDDLF DPSLSMVYVS VMSRDRFDFL
    IRCLRMDDKS IRPTLRENDV

241 FTPVRKIWDL FIHQCIQNYT PGAHLTIDEQ LLGFRGRCPF
    RVYIPNKPSK YGIKILMMCD

301 SGTKYMINGM PYLGRGTQTN GVPLGEYYVK ELSKPVHGSC
    RNITCDNWFT SIPLAKNLLQ

361 EPYKLTIVGT VRSNKREIPE VLKNSRSRPV GTSMFCFDGP
    LTLVSYKPKP AKMVYLLSSC

421 DEDASINEST GKPQMVMYYN QTKGGVDTLD QMCSVMTCSR
    KTNRWPMALL YGMINIACIN

481 SFIIYSHNVS SKGEKVQSRK KFMRNLYMSL TSSFMRKRLE
    APTLKRYLRD NISNILPKEV
```

-continued
```
541 PGTSDDSTEE PVMKKRTYCT YCRSKIRRKA NASCKKCKKV
    ICREHNIDMC QSCF.
```

In certain embodiments of the disclosure, including those embodiments wherein the transposase comprises the above-described mutations at positions 30, 165, 282 and/or 538, the piggyBac™ or Super piggyBac™ transposase enzyme may further comprise an amino acid substitution at one or more of positions 3, 46, 82, 103, 119, 125, 177, 180, 185, 187, 200, 207, 209, 226, 235, 240, 241, 243, 258, 296, 298, 311, 315, 319, 327, 328, 340, 421, 436, 456, 470, 486, 503, 552, 570 and 591 of the sequence of SEQ ID NO: 1 or SEQ ID NO: 2. In certain embodiments, including those embodiments wherein the transposase comprises the above-described mutations at positions 30, 165, 282 and/or 538, the piggyBac™ or Super piggyBac™ transposase enzyme may further comprise an amino acid substitution at one or more of positions 46, 119, 125, 177, 180, 185, 187, 200, 207, 209, 226, 235, 240, 241, 243, 296, 298, 311, 315, 319, 327, 328, 340, 421, 436, 456, 470, 485, 503, 552 and 570. In certain embodiments, the amino acid substitution at position 3 of SEQ ID NO: 1 or SEQ ID NO: 2 is a substitution of an asparagine (N) for a serine (S). In certain embodiments, the amino acid substitution at position 46 of SEQ ID NO: 1 or SEQ ID NO: 2 is a substitution of a serine (S) for an alanine (A). In certain embodiments, the amino acid substitution at position 46 of SEQ ID NO: 1 or SEQ ID NO: 2 is a substitution of a threonine (T) for an alanine (A). In certain embodiments, the amino acid substitution at position 82 of SEQ ID NO: 1 or SEQ ID NO: 2 is a substitution of a tryptophan (W) for an isoleucine (I). In certain embodiments, the amino acid substitution at position 103 of SEQ ID NO: 1 or SEQ ID NO: 2 is a substitution of a proline (P) for a serine (S). In certain embodiments, the amino acid substitution at position 119 of SEQ ID NO: 1 or SEQ ID NO: 2 is a substitution of a proline (P) for an arginine (R). In certain embodiments, the amino acid substitution at position 125 of SEQ ID NO: 1 or SEQ ID NO: 2 is a substitution of an alanine (A) a cysteine (C). In certain embodiments, the amino acid substitution at position 125 of SEQ ID NO: 1 or SEQ ID NO: 2 is a substitution of a leucine (L) for a cysteine (C). In certain embodiments, the amino acid substitution at position 177 of SEQ ID NO: 1 or SEQ ID NO: 2 is a substitution of a lysine (K) for a tyrosine (Y). In certain embodiments, the amino acid substitution at position 177 of SEQ ID NO: 1 or SEQ ID NO: 2 is a substitution of a histidine (H) for a tyrosine (Y). In certain embodiments, the amino acid substitution at position 180 of SEQ ID NO: 1 or SEQ ID NO: 2 is a substitution of a leucine (L) for a phenylalanine (F). In certain embodiments, the amino acid substitution at position 180 of SEQ ID NO: 1 or SEQ ID NO: 2 is a substitution of an isoleucine (I) for a phenylalanine (F). In certain embodiments, the amino acid substitution at position 180 of SEQ ID NO: 1 or SEQ ID NO: 2 is a substitution of a valine (V) for a phenylalanine (F). In certain embodiments, the amino acid substitution at position 185 of SEQ ID NO: 1 or SEQ ID NO: 2 is a substitution of a leucine (L) for a methionine (M). In certain embodiments, the amino acid substitution at position 187 of SEQ ID NO: 1 or SEQ ID NO: 2 is a substitution of a glycine (G) for an alanine (A). In certain embodiments, the amino acid substitution at position 200 of SEQ ID NO: 1 or SEQ ID NO: 2 is a substitution of a tryptophan (W) for a phenylalanine (F). In certain embodiments, the amino acid substitution at position 207 of SEQ ID NO: 1 or SEQ ID NO: 2 is a substitution of a proline (P) for a valine (V). In certain embodiments, the amino acid substitution at position 209 of SEQ ID NO: 1 or SEQ ID NO: 2 is a substitution of a phenylalanine (F) for a valine (V). In certain embodiments, the amino acid substitution at position 226 of SEQ ID NO: 1 or SEQ ID NO: 2 is a substitution of a phenylalanine (F) for a methionine (M). In certain embodiments, the amino acid substitution at position 235 of SEQ ID NO: 1 or SEQ ID NO: 2 is a substitution of an arginine (R) for a leucine (L). In certain embodiments, the amino acid substitution at position 240 of SEQ ID NO: 1 or SEQ ID NO: 1 is a substitution of a lysine (K) for a valine (V). In certain embodiments, the amino acid substitution at position 241 of SEQ ID NO: 1 or SEQ ID NO: 2 is a substitution of a leucine (L) for a phenylalanine (F). In certain embodiments, the amino acid substitution at position 243 of SEQ ID NO: 1 or SEQ ID NO: 2 is a substitution of a lysine (K) for a proline (P). In certain embodiments, the amino acid substitution at position 258 of SEQ ID NO: 1 or SEQ ID NO: 2 is a substitution of a serine (S) for an asparagine (N). In certain embodiments, the amino acid substitution at position 296 of SEQ ID NO: 1 or SEQ ID NO: 2 is a substitution of a tryptophan (W) for a leucine (L). In certain embodiments, the amino acid substitution at position 296 of SEQ ID NO: 1 or SEQ ID NO: 2 is a substitution of a tyrosine (Y) for a leucine (L). In certain embodiments, the amino acid substitution at position 296 of SEQ ID NO: 1 or SEQ ID NO: 2 is a substitution of a phenylalanine (F) for a leucine (L). In certain embodiments, the amino acid substitution at position 298 of SEQ ID NO: 1 or SEQ ID NO: 2 is a substitution of a leucine (L) for a methionine (M). In certain embodiments, the amino acid substitution at position 298 of SEQ ID NO: 1 or SEQ ID NO: 2 is a substitution of an alanine (A) for a methionine (M). In certain embodiments, the amino acid substitution at position 298 of SEQ ID NO: 1 or SEQ ID NO: 2 is a substitution of a valine (V) for a methionine (M). In certain embodiments, the amino acid substitution at position 311 of SEQ ID NO: 1 or SEQ ID NO: 2 is a substitution of an isoleucine (I) for a proline (P). In certain embodiments, the amino acid substitution at position 311 of SEQ ID NO: 1 or SEQ ID NO: 2 is a substitution of a valine for a proline (P). In certain embodiments, the amino acid substitution at position 315 of SEQ ID NO: 1 or SEQ ID NO: 2 is a substitution of a lysine (K) for an arginine (R). In certain embodiments, the amino acid substitution at position 319 of SEQ ID NO: 1 or SEQ ID NO: 2 is a substitution of a glycine (G) for a threonine (T). In certain embodiments, the amino acid substitution at position 327 of SEQ ID NO: 1 or SEQ ID NO: 2 is a substitution of an arginine (R) for a tyrosine (Y). In certain embodiments, the amino acid substitution at position 328 of SEQ ID NO: 1 or SEQ ID NO: 2 is a substitution of a valine (V) for a tyrosine (Y). In certain embodiments, the amino acid substitution at position 340 of SEQ ID NO: 1 or SEQ ID NO: 2 is a substitution of a glycine (G) for a cysteine (C). In certain embodiments, the amino acid substitution at position 340 of SEQ ID NO: 1 or SEQ ID NO: 2 is a substitution of a leucine (L) for a cysteine (C). In certain embodiments, the amino acid substitution at position 421 of SEQ ID NO: 1 or SEQ ID NO: 2 is a substitution of a histidine (H) for the aspartic acid (D). In certain embodiments, the amino acid substitution at position 436 of SEQ ID NO: 1 or SEQ ID NO: 2 is a substitution of an isoleucine (I) for a valine (V). In certain embodiments, the amino acid substitution at position 456 of SEQ ID NO: 1 or SEQ ID NO: 2 is a substitution of a tyrosine (Y) for a methionine (M). In certain embodiments, the amino acid substitution at position 470 of SEQ ID NO: 1 or SEQ ID NO: 2 is a substitution of a phenylalanine (F) for a leucine (L).

In certain embodiments, the amino acid substitution at position 485 of SEQ ID NO: 1 or SEQ ID NO: 2 is a substitution of a lysine (K) for a serine (S). In certain embodiments, the amino acid substitution at position 503 of SEQ ID NO: 1 or SEQ ID NO: 2 is a substitution of a leucine (L) for a methionine (M). In certain embodiments, the amino acid substitution at position 503 of SEQ ID NO: 1 or SEQ ID NO: 2 is a substitution of an isoleucine (I) for a methionine (M). In certain embodiments, the amino acid substitution at position 552 of SEQ ID NO: 1 or SEQ ID NO: 2 is a substitution of a lysine (K) for a valine (V). In certain embodiments, the amino acid substitution at position 570 of SEQ ID NO: 1 or SEQ ID NO: 2 is a substitution of a threonine (T) for an alanine (A). In certain embodiments, the amino acid substitution at position 591 of SEQ ID NO: 1 or SEQ ID NO: 2 is a substitution of a proline (P) for a glutamine (Q). In certain embodiments, the amino acid substitution at position 591 of SEQ ID NO: 1 or SEQ ID NO: 2 is a substitution of an arginine (R) for a glutamine (Q).

In certain embodiments of the disclosure, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at one or more of positions 103, 194, 372, 375, 450, 509 and 570 of the sequence of SEQ ID NO: 1 or SEQ ID NO: 2. In certain embodiments of the methods of the disclosure, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at two, three, four, five, six or more of positions 103, 194, 372, 375, 450, 509 and 570 of the sequence of SEQ ID NO: 1 or SEQ ID NO: 2. In certain embodiments, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at positions 103, 194, 372, 375, 450, 509 and 570 of the sequence of SEQ ID NO: 1 or SEQ ID NO: 2. In certain embodiments, the amino acid substitution at position 103 of SEQ ID NO: 1 or SEQ ID NO: 2 is a substitution of a proline (P) for a serine (S). In certain embodiments, the amino acid substitution at position 194 of SEQ ID NO: 1 or SEQ ID NO: 2 is a substitution of a valine (V) for a methionine (M). In certain embodiments, the amino acid substitution at position 372 of SEQ ID NO: 1 or SEQ ID NO: 2 is a substitution of an alanine (A) for an arginine (R). In certain embodiments, the amino acid substitution at position 375 of SEQ ID NO: 1 or SEQ ID NO: 2 is a substitution of an alanine (A) for a lysine (K). In certain embodiments, the amino acid substitution at position 450 of SEQ ID NO: 1 or SEQ ID NO: 2 is a substitution of an asparagine (N) for an aspartic acid (D). In certain embodiments, the amino acid substitution at position 509 of SEQ ID NO: 1 or SEQ ID NO: 2 is a substitution of a glycine (G) for a serine (S). In certain embodiments, the amino acid substitution at position 570 of SEQ ID NO: 1 or SEQ ID NO: 2 is a substitution of a serine (S) for an asparagine (N). In certain embodiments, the piggyBac™ transposase enzyme may comprise a substitution of a valine (V) for a methionine (M) at position 194 of SEQ ID NO: 1. In certain embodiments, including those embodiments wherein the piggyBac™ transposase enzyme may comprise a substitution of a valine (V) for a methionine (M) at position 194 of SEQ ID NO: 1, the piggyBac™ transposase enzyme may further comprise an amino acid substitution at positions 372, 375 and 450 of the sequence of SEQ ID NO: 1 or SEQ ID NO: 2. In certain embodiments, the piggyBac™ transposase enzyme may comprise a substitution of a valine (V) for a methionine (M) at position 194 of SEQ ID NO: 1, a substitution of an alanine (A) for an arginine (R) at position 372 of SEQ ID NO: 1, and a substitution of an alanine (A) for a lysine (K) at position 375 of SEQ ID NO: 1. In certain embodiments, the piggyBac™ transposase enzyme may comprise a substitution of a valine (V) for a methionine (M) at position 194 of SEQ ID NO: 1, a substitution of an alanine (A) for an arginine (R) at position 372 of SEQ ID NO: 1, a substitution of an alanine (A) for a lysine (K) at position 375 of SEQ ID NO: 1 and a substitution of an asparagine (N) for an aspartic acid (D) at position 450 of SEQ ID NO: 1.

In certain embodiments of the disclosure, the transposase enzyme is a Sleeping Beauty transposase enzyme (see, for example, U.S. Pat. No. 9,228,180, the contents of which are incorporated herein in their entirety). In certain embodiments, the Sleeping Beauty transposase is a hyperactive Sleeping Beauty (SB100X) transposase. In certain embodiments, the Sleeping Beauty transposase enzyme comprises an amino acid sequence at least 75% identical to:

(SEQ ID NO: 17031)
MGKSKEISQDLRKKIVDLHKSGSSLGAISKRLKVPRSSVQTIVRKYKHHG

TTQPSYRSGRRRYLSPRDERTLVRKVQINPRTTAKDLVKMLEETGTKVSI

STVKRVLYRHNLKGRSARKKPLLQNRHKKARLRFATAHGDKDRTFWRNVL

WSDETKIELFGHNDHRYVWRKKGEACKPKNTIPTVKHGGGSIMLWGCFAA

GGTGALHKIDGIMRKENYVDILKQHLKTSVRKLKLGRKWVFQMDNDPKHT

SKVVAKWLKDNKVKVLEWPSQSPDLNPIENLWAELKKRVRARRPTNLTQL

HQLCQEEWAKIHPTYCGKLVEGYPKRLTQVKQFKGNATKY.

In certain embodiments, including those wherein the Sleeping Beauty transposase is a hyperactive Sleeping Beauty (SB100X) transposase, the Sleeping Beauty transposase enzyme comprises an amino acid sequence at least 75% identical to:

(SEQ ID NO. 17032)
MGKSKEISQDLRKRIVDLHKSGSSLGAISKRLAVPRSSVQTIVRKYKHHG

TTQPSYRSGRRRYLSPRDERTLVRKVQINPRTTAKDLVKMLEETGTKVSI

STVKRVLYRHNLKGHSARKKPLLQNRHKKARLRFATAHGDKDRTFWRNVL

WSDETKIELFGHNDHRYVWRKKGEACKPKNTIPTVKHGGGSIMLWGCFAA

GGTGALHKIDGIMDAVQYVDILKQHLKTSVRKLKLGRKWVFQHDNDPKHT

SKVVAKWLKDNKVKVLEWPSQSPDLNPIENLWAELKKRVRARRPTNLTQL

HQLCQEEWAKIHPNYCGKLVEGYPKRLTQVKQFKGNATKY.

In certain embodiments of the compositions of the disclosure, the first transposon and/or the second transposon further comprises a selection gene. In certain embodiments, the selection gene comprises neo, DHFR (Dihydrofolate Reductase), TYMS (Thymidylate Synthetase), MGMT (O(6)-methylguanine-DNA methyltransferase), multidrug resistance gene (MDR1), ALDH1 (Aldehyde dehydrogenase 1 family, member A1), FRANCF, RAD51C (RAD51 Paralog C), GCS (glucosylceramide synthase), NKX2.2 (NK2 Homeobox 2) or any combination thereof. In certain embodiments, the selection gene comprises DHFR In certain embodiments of the compositions of the disclosure, the first transposon and or the second transposon comprises an inducible caspase polypeptide comprising (a) a ligand binding region, (b) a linker, and (c) a truncated caspase 9 polypeptide, wherein the inducible caspase polypeptide does not comprise a non-human sequence. In certain embodiments, the non-human sequence is a restriction site. In certain embodiments, the ligand binding region inducible caspase polypeptide comprises a FK506 binding protein 12 (FKBP12) polypeptide. In certain embodiments, the amino acid sequence of the FK506 binding protein 12 (FKBP12) polypeptide comprises a modification at position 36 of the sequence. In certain embodiments, the modification is a substitution of valine (V) for phenylalanine (F) at position 36 (F36V). In certain embodiments, the FKBP12 polypeptide is encoded by an amino acid sequence comprising GVQVETISPGDGRTFPKRGQTCVVHYTGMLEDGK-KVDSSRDRNKPFKFMLGKQEVI RGWEEGVAQMSVGQRAKLTISPDYAYGATGHPGIIP-PHATLVFDVELLKLE (SEQ ID NO: 17012). In certain embodiments, the FKBP12 polypeptide is encoded by a nucleic acid sequence comprising (SEQ ID NO: 17013)
GGGGTCCAGGTCGAGACTATTTCACCAGGGGATGGGCGAACATTTCCAAA

AAGGGGCCAGACTTGCGTCGTGCATTACACCGGGATGCTGGAGGACGGGA

AGAAAGTGGACAGCTCCAGGGATCGCAACAAGCCCTTCAAGTTCATGCTG

GGAAAGCAGGAAGTGATCCGAGGATGGGAGGAAGGCGTGGCACAGATGTC

AGTCGGCCAGCGGGCCAAACTGACCATTAGCCCTGACTACGCTTATGGAG

CAACAGGCCACCCAGGGATCATTCCCCCTCATGCCACCCTGGTCTTCGAT

GTGGAACTGCTGAAGCTGGAG.

In certain embodiments, the linker region of the inducible proapoptotic polypeptide is encoded by an amino acid comprising GGGGS (SEQ ID NO: 17014). In certain embodiments, the linker region of the inducible proapoptotic polypeptide is encoded by a nucleic acid sequence comprising GGAGGAGGAGGATCC (SEQ ID NO: 17015).

In certain embodiments, the truncated caspase 9 polypeptide of the inducible proapoptotic polypeptide is encoded by an amino acid sequence that does not comprise an arginine (R) at position 87 of the sequence. In certain embodiments, the truncated caspase 9 polypeptide of the inducible proapoptotic polypeptide is encoded by an amino acid sequence that does not comprise an alanine (A) at position 282 the sequence. In certain embodiments, the truncated caspase 9 polypeptide of the inducible proapoptotic polypeptide is encoded by an amino acid comprising GFGDV-GALESLRGNADLAYILSMEPCGHCLI-INNVNFCRESGLRTRTGSNIDCEKLRR RFSSLHFMVEVKGDLTAKKMVLALLE-LAQQDHGALDCCVVVILSHGCQASHLQFPG AVYGTDGCPVS-VEKIVNIFNGTSCPSLGGKPKLFFIQACGGEQKDHGFE-VASTSPEDE SPGSNPEPDATPFQEGLRTFDQL-DAISSLPTPSDIFVSYSTFPGFVSWRDPKSGSWYVE TLDDIFEQWAHSEDLQSLLLRVA-NAVSVKGIYKQMPGCFNFLRKKLFFKTS (SEQ ID NO: 17016). In certain embodiments, the truncated caspase 9 poly peptide of the inducible proapoptotic polypeptide is encoded by a nucleic acid sequence comprising (SEQ ID NO: 17017)
TTTGGGGACGTGGGGGCCCTGGAGTCTCTGCGAGGAAATGCCGATCTGGC

TTACATCCTGAGCATGGAACCCTGCGGCCACTGTCTGATCATTAACAATG

TGAACTTCTGCAGAGAAAGCGGACTGCGAACACGGACTGGCTCCAATATT

GACTGTGAGAAGCTGCGGAGAAGGTTCTCTAGTCTGCACTTTATGGTCGA

AGTGAAAGGGGATCTGACCGCCAAGAAAATGGTGCTGGCCCTGCTGGAGC

TGGCTCAGCAGGACCATGGAGCTCTGGATTGCTGCGTGGTCGTGATCCTG

TCCCACGGGTGCCAGGCTTCTCATCTGCAGTTCCCCGGAGCAGTGTACGG

AACAGACGGCTGTCCTGTCAGCGTGGAGAAGATCGTCAACATCTTCAACG

GCACTTCTTGCCCTAGTCTGGGGGGAAAGCCAAAACTGTTCTTTATCCAG

GCCTGTGGCGGGAACAGAAAGATCACGGCTTCGAGGTGGCCAGCACCAG

CCCTGAGGACGAATCACCAGGGAGCAACCCTGAACCAGATGCAACTCCAT

TCCAGGAGGGACTGAGGACCTTTGACCAGCTGGATGCTATCTCAAGCCTG

CCCACTCCTAGTGACATTTTCGTGTCTTACAGTACCTTCCCAGGCTTTGT

CTCATGGCGCGATCCCAAGTCAGGGAGCTGGTACGTGGAGACACTGGACG

ACATCTTTGAACAGTGGGCCCATTCAGAGGACCTGCAGAGCCTGCTGCTG

CGAGTGGCAAACGCTGTCTCTGTGAAGGGCATCTACAAACAGATGCCCGG

GTGCTTCAATTTTCTGAGAAAGAAACTGTTCTTTAAGACTTCC.

In certain embodiments, the inducible proapoptotic polypeptide is encoded by an amino acid sequence comprising GVQVETISPGDGRTFPKRGQTCVVHYTGMLEDGK-KVDSSRDRNKPFKFMLGKQEVI RGWEEGVAQMSVGQRAKLTISPDYAYGATGHPGIIP-PHATLVFDVELLKLEGGGGS GFGDVGALESLRG-NADLAYILSMEPCGHCLIINNVNFCRESGLRTRTG-SNIDCEKLRR RFSSLHFMVEVKGDTTAKKMVLALLE-LAQQDHGALDCCVVVILSHGCQASHLQFPG AVYGTDGCPVS-VEKIVNIFNGTSCPSLGGKPKLFFIQACGGEQKDHGFE-VASTSPEDE SPGSNPEPDATPFQEGLRTFDQL-DAISSLPTPSDIFVSYSTFPGFVSWRDPKSGSWYVE TLDDIFEQWAHSEDLQSLLLRVA-NAVSVKGIYKQMPGCFNFLRKKLFFKTS (SEQ ID NO: 17018) In certain embodiments, the inducible proapoptotic polypeptide is encoded by a nucleic acid sequence comprising (SEQ ID NO: 17019)
Ggggtccaggtcgagactatttcaccaggggatgggcgaacatttccaaa aaggggccagacttgcgtcgtgcattacaccgggatgctggaggacggga agaaagtggacagctccagggatcgcaacaagcccttcaagttcatgctg ggaaagcaggaagtgatccgaggatgggaggaaggcgtggcacagatgtc agtcggccagcgggccaaactgaccattagccctgactacgcttatggag caacaggccacccagggatcattccccctcatgccaccctggtcttcgat gtggaactgctgaagctggagggaggaggaggatccggatttggggacgt gggggccctggagtctctgcgaggaaatgccgatctggcttacatcctga gcatggaaccctgcggccactgtctgatcattaacaatgtgaacttctgc agagaaagcggactgcgaacacggactggctccaatattgactgtgagaa gctgcggagaaggttctctagtctgcactttatggtcgaagtgaaagggg atctgaccgccaagaaaatggtgctggccctgctggagctggctcagcag gaccatggagctctggattgctgcgtggtcgtgatcctgtcccacgggtg ccaggcttctcatctgcagttccccggagcagtgtacggaacagacggct gtcctgtcagcgtggagaagatcgtcaacatcttcaacggcacttcttgc cctagtctgggggggaaagccaaaactgttctttatccaggcctgtggcgg ggaacagaaagatcacggcttcgaggtggccagcaccagccctgaggacg aatcaccagggagcaaccctgaaccagatgcaactccattccaggaggga ctgaggacctttgaccagctggatgctatctcaagcctgcccactcctag tgacattttcgtgtcttacagtaccttcccaggctttgtctcatggcgcg atcccaagtcagggagctggtacgtggagacactggacgacatctttgaa cagtgggcccattcagaggacctgcagagcctgctgctgcgagtggcaaa cgctgtctctgtgaagggcatctacaaacagatgcccgggtgcttcaatt ttctgagaaagaaactgttctttaagacttcc.

In certain embodiments of the compositions of the disclosure, the first transposon and/or the second transposon comprises at least one self-cleaving peptide. In certain embodiments, the at least one self-cleaving peptide comprises a T2A peptide, a GSG-T2A peptide, an E2A peptide, a GSG-E2A peptide, an F2A peptide, a GSG-F2A peptide, a P2A peptide, or a GSG-P2A peptide. In certain embodiments, the at least one self-cleaving peptide comprises a T2A peptide. In certain embodiments, the T2A peptide comprises an amino acid sequence comprising EGRGSLLTCGDVEENPGP (SEQ ID NO: 17020). In certain embodiments, the GSG-T2A peptide comprises an amino acid sequence comprising GSGEGRGSLLTCGD-VEENPGP (SEQ ID NO: 17021). In certain embodiments, the E2A peptide comprises an amino acid sequence comprising QCTNYALLKLAGDVESNPGP (SEQ ID NO: 17022). In certain embodiments, the GSG-E2A peptide comprises an amino acid sequence comprising GSGQCTNYALLKLAGDVESNPGP (SEQ ID NO: 17023). In certain embodiments, the F2A peptide comprises an amino acid sequence comprising VKQTLNFDLLKLAGDVESNPGP (SEQ ID NO: 17024). In certain embodiments, the GSG-F2A peptide comprises an amino acid sequence comprising GSGVKQTLNFDLLKLAGDVESNPGP (SEQ ID NO: 17025). In certain embodiments, the P2A peptide comprises an amino acid sequence comprising ATNFSLLKQAGD-VEENPGP (SEQ ID NO: 17026). In certain embodiments, the GSG-P2A peptide comprises an amino acid sequence comprising GSGATNFSLLKQAGDVEENPGP (SEQ ID NO: 17027). In certain embodiments, the at least one self-cleaving peptide is positioned between (a) the selection gene and the inducible transgene construct or (b) the inducible transgene construct and the inducible caspase polypeptide. In certain embodiments, the at least one self-cleaving peptide is positioned between (a) the selection gene and the reporter construct or (b) the reporter construct and the inducible caspase polypeptide.

The disclosure provides a cell comprising the composition of the disclosure.

The disclosure provides a method of inducing conditional gene expression in a cell comprising (a) contacting the cell with a composition of the disclosure, under conditions suitable to allow for integration of the inducible transgene construct into the genome of the cell and for the expression of the exogenous reporter and (b) contacting the exogenous receptor and a ligand that specifically binds thereto, to transduce an intracellular signal that targets the inducible promoter, thereby modifying gene expression. In certain embodiments, the cell is in vivo, ex vivo, in vitro or in situ. In certain embodiments, the cell is an immune cell. In certain embodiments, the immune cell is a T-cell, a Natural Killer (NK) cell, a Natural Killer (NK)-like cell, a hematopoeitic progenitor cell, a peripheral blood (PB) derived T cell or an umbilical cord blood (UCB) derived T-cell. In certain embodiments, the immune cell is a T-cell. In certain embodiments, the cell is autologous. In certain embodiments, the cell is allogeneic.

The disclosure provides a method of treating a disease or disorder in a subject in need thereof, comprising administering to the subject a composition of the disclosure, under conditions suitable to allow for integration of the inducible transgene construct into the genome of the cell and for the expression of the exogenous reporter, and administering a ligand to which the exogenous receptor selectively binds, wherein the binding of the ligand to the exogenous receptor transduces an intracellular signal to target the inducible promoter controlling the transgene, wherein the transgene is expressed, and wherein the product of the transgene is therapeutically-effective for treating the disease or disorder. In certain embodiments, the product of the transgene is a secreted protein. In certain embodiments, the secreted protein is a clotting factor. In certain embodiments, the clotting factor is factor IX. In certain embodiments, the disease or disorder is a clotting disorder.

In certain embodiments of the methods of the disclosure, conditions suitable to allow for integration of the inducible transgene construct into the genome of the cell and for the expression of the exogenous reporter comprise in vivo conditions. In certain embodiments, conditions suitable to allow for integration of the inducible transgene construct into the genome of the cell and for the expression of the exogenous reporter comprise a temperature substantially similar to an internal temperature of a human body, a $CO_2$ level substantially similar to an internal $CO_2$ levels of a human body, an $O_2$ level substantially similar to an internal $O_2$ levels of a human body, an aqueous or saline environment with a level of electrolytes substantially similar to a level of electrolytes of an interior of a human body.

In certain embodiments of the compositions and methods of the disclosure, the ligand to which the exogenous receptor specifically binds is non-naturally occurring. In certain embodiments, the ligand is a nucleic acid, an amino acid, a polymer, an organic small molecule, an inorganic small molecule, or a combination thereof. Exemplary ligands include, but are not limited to, synthetic, modified, recombinant, mutant, chimeric, endogenous or non-naturally occurring, proteins (soluble or membrane-bound), steroid hormones, gas particles, nucleic acids, growth factors, neurotransmitters, vitamins, and minerals.

The disclosure provides a composition comprising (a) an inducible transgene construct, comprising a sequence encoding an inducible promoter and a sequence encoding a transgene, and (b) a ligand construct, comprising a sequence encoding a constitutive promoter and a sequence encoding an exogenous ligand, wherein, upon integration of the construct of (a) and the construct of (b) into a genomic sequence of a cell, the exogenous ligand is expressed, and wherein the exogenous ligand, upon binding a receptor, transduces an intracellular signal that targets the inducible promoter of (a) to modify gene expression. In certain embodiments, the ligand comprises a non-natural or synthetic sequence. In certain embodiments, the ligand comprises a fusion protein. In certain embodiments, the ligand is bound to the surface of the cell. In certain embodiments, the ligand comprises an intracellular domain. In certain embodiments, the intracellular domain transduces a signal in the cell expressing the ligand. In certain embodiments, the structure of the ligand is substantially similar to the structure of the receptor of the compositions of the disclosure. In certain embodiments, the signal transduced by the ligand and the signal transduced by the receptor comprise a bi-directional signal.

BRIEF DESCRIPTION OF THE DRAWINGS

FIG. 8 is a series of graphs demonstrating that the expression level of inducible gene can be regulated by number of response elements preceding the promoter in CD4 positive cells. Truncated CD19 (dCD19) expressing CAR-T cells were stimulated by BCMA+ H929 multiple myeloma cells at 2:1 CAR-T:H929 ratio. The expression of dCD19 was driven by the minimal promoter that enhanced by 0, 1, 2, 3, 4 or 5 repeats of the NF-kB response element. The expression of BCMA CAR was driven by human elongation factor-α (EF-1α) promoter, a constitutive promoter that is commonly used for gene expression in human T cells. Before tumor cell stimulation, the expression of CAR and dCD19 were both at basal levels compared to mock T cell control. The expression levels of CAR and dCD19 were both upregulated upon tumor stimulation (day 3) and then subsequently downregulated (day 9, 14) and eventually reached their respective basal levels when the cells resume a fully rested status again (day 20). However. CAR surface expression was equivalently up- or downregulated in all the CAR-T cell samples during cell activation and resting process, while the expression levels of dCD19 were directly proportional to the number of NF-κB response elements (day 3, 9, 14). Data are shown as FACS histograms and MFI of target protein staining. Thus, surface dCD19 expression was directly proportional with the number of REs encoded in the GES. No dCD19 was detected on the surface of T cells that did not harbor the GES: No GES and Mock controls.

DETAILED DESCRIPTION

Figure 1A:
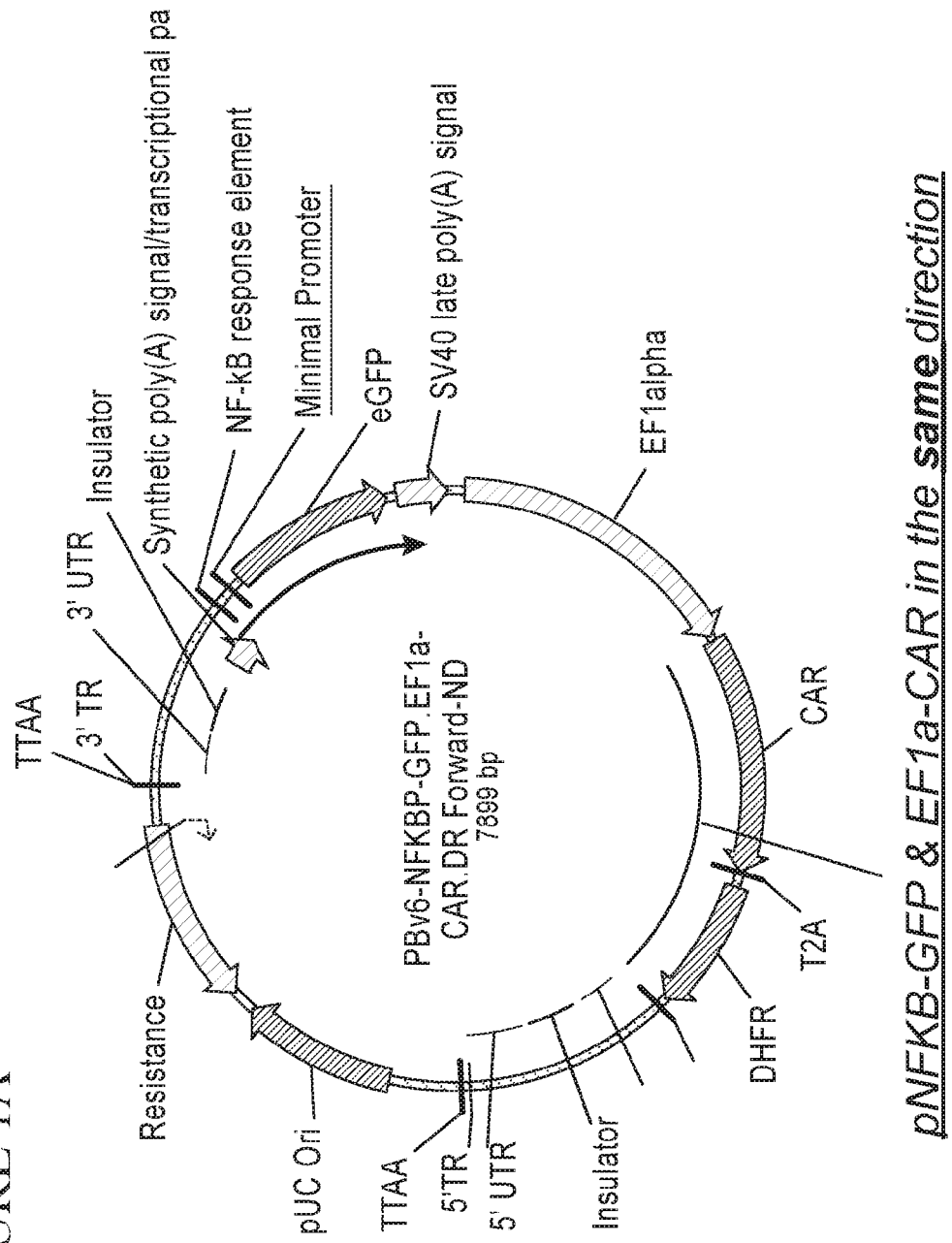
FIG. 1A-B is a pair of schematic diagrams depicting NF-KB inducible vectors for expression in T-cells. Two T cell activation NF-KB inducible vectors were developed; one with the gene expression system (GES) in the forward orientation (A) and the other in the complementary direction (B), both preceding the constitutive EF1a promoter. These vectors also direct expression of a CAR molecule and a DHFR selection gene, separated by a T2A sequence. Both the conditional NF-KB inducible system and the EF1a directed genes are a part of a piggyBac transposon which can be permanently integrated into T cells using electroporation (EP). Once integrated into the genome, the T cells will constitutively express the CAR on the membrane surface and the DHFR within the cell, while expression of the NF-KB inducible gene, GFP, will be expressed to the highest level only upon T cell activation.
Figure 1B:
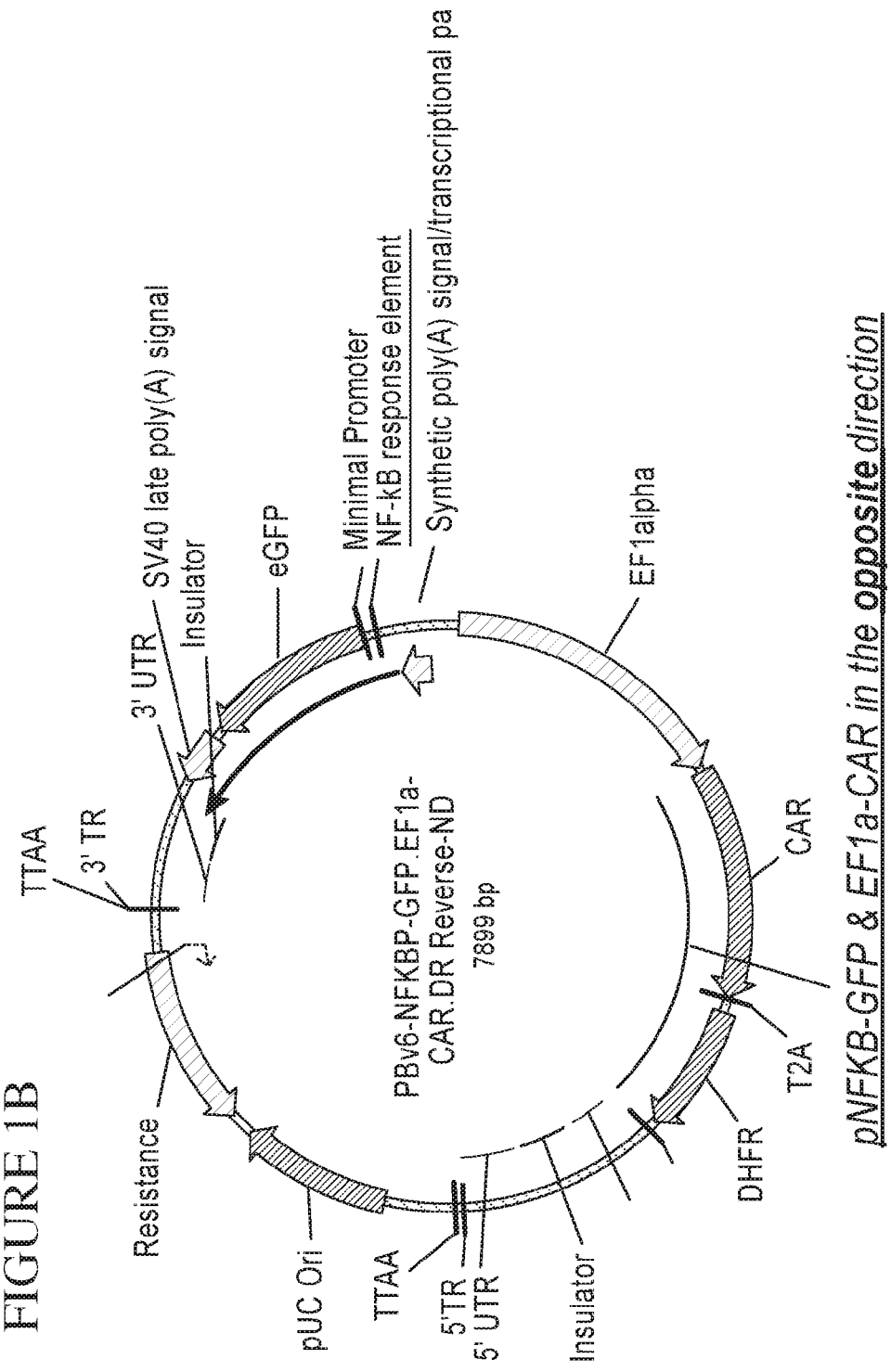

The disclosure provides a composition comprising (a) an inducible transgene construct, comprising a sequence encoding an inducible promoter and a sequence encoding a transgene, and (b) a receptor construct, comprising a sequence encoding a constitutive promoter and a sequence encoding an exogenous receptor, wherein, upon integration of the construct of (a) and the construct of (b) into a genomic sequence of a cell, the exogenous reporter is expressed, and wherein the exogenous reporter, upon binding a ligand, transduces an intracellular signal that targets the inducible promoter of (a) to modify gene expression.

Exogenous Receptors

Exogenous receptors of the disclosure may comprise a non-naturally occurring receptor. In certain embodiments, the non-naturally occurring receptor is a synthetic, modified, recombinant, mutant or chimeric receptor. In certain embodiments, the non-naturally occurring receptor comprises one or more sequences isolated or derived from a T-cell receptor (TCR). In certain embodiments, the non-naturally occurring receptor comprises one or more sequences isolated or derived from a scaffold protein. In certain embodiments, the non-naturally occurring receptor comprises a transmembrane domain. In certain embodiments, the non-naturally occurring receptor interacts with an intracellular receptor that transduces an intracellular signal. In certain embodiments, the non-naturally occurring receptor comprises an intracellular signaling domain. In certain embodiments, the non-naturally occurring receptor is a chimeric ligand receptor (CLR). In certain embodiments, the CLR is a chimeric antigen receptor.

In certain embodiments of the compositions of the disclosure, the exogenous receptor of (b) comprises a non-naturally occurring receptor. In certain embodiments, the CLR is a chimeric antigen receptor. In certain embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain.

The disclosure provides chimeric receptors comprising at least one Centyrin. Chimeric ligand/antigen receptors (CLRs/CARs) of the disclosure may comprise more than one Centyrin, referred to herein as a CARTyrin.

The disclosure provides chimeric receptors comprising at least one VHH. Chimeric ligand/antigen receptors (CLRs/CARs) of the disclosure may comprise more than one VHH, referred to herein as a VCAR.

Chimeric receptors of the disclosure may comprise a signal peptide of human CD2, CD3δ, CD3ε, CD3γ, CD3ζ, CD4, CD8α, CD19, CD28, 4-1BB or GM-CSFR. A hinge/spacer domain of the disclosure may comprise a hinge/spacer/stalk of human CD8α, IgG4, and/or CD4. An intracellular domain or endodomain of the disclosure may comprise an intracellular signaling domain of human CD3ζ and may further comprise human 4-1BB, CD28, CD40, ICOS, MyD88, OX-40 intracellular segment, or any combination thereof. Exemplary transmembrane domains include, but are not limited to a human CD2, CD36. CD3e, CD3γ, CD3ζ, CD4, CD8α. CD19, CD28, 4-1BB or GM-CSFR transmembrane domain.

The disclosure provides genetically modified cells, such as T cells, NK cells, hematopoietic progenitor cells, peripheral blood (PB) derived T cells (including T cells from G-CSF-mobilized peripheral blood), umbilical cord blood (UCB) derived T cells rendered specific for one or more ligands or antigens by introducing to these cells a CLR/CAR. CARTyrin and/or VCAR of the disclosure. Cells of the disclosure may be modified by electrotransfer of a transposon of the disclosure and a plasmid or a nanoplasmid comprising a sequence encoding a transposase of the disclosure (preferably, the sequence encoding a transposase of the disclosure is an mRNA sequence).

In some embodiments, the armored T-cell comprises a composition comprising (a) an inducible transgene construct, comprising a sequence encoding an inducible promoter and a sequence encoding a transgene, and (b) a receptor construct, comprising a sequence encoding a constitutive promoter and a sequence encoding an exogenous receptor, such as a CLR or CAR, wherein, upon integration of the construct of (a) and the construct of (b) into a genomic sequence of a cell, the exogenous receptor is expressed, and wherein the exogenous receptor, upon binding a ligand or antigen, transduces an intracellular signal that targets directly or indirectly the inducible promoter regulating expression of the inducible transgene (a) to modify gene expression.

Chimeric Receptors

Chimeric antigen receptors (CARs) and/or chimeric ligand receptors (CLRs) of the disclosure may comprise (a) an ectodomain comprising an antigen/ligand recognition region, (b) a transmembrane domain, and (c) an endodomain comprising at least one costimulatory domain. In certain embodiments, the ectodomain may further comprise a signal peptide. Alternatively, or in addition, in certain embodiments, the ectodomain may further comprise a hinge between the antigen/ligand recognition region and the transmembrane domain. In certain embodiments of the CARs of the disclosure, the signal peptide may comprise a sequence encoding a human CD2, CD3δ, CD3ε, CD3γ, CD3ζ, CD4, CD8α, CD19, CD28, 4-1BB or GM-CSFR signal peptide. In certain embodiments of the CARs of the disclosure, the signal peptide may comprise a sequence encoding a human CD8α signal peptide. In certain embodiments, the transmembrane domain may comprise a sequence encoding a human CD2, CD3δ, CD3ε, CD3γ, CD3ζ, CD4, CD8α, CD19, CD28, 4-1BB or GM-CSFR transmembrane domain. In certain embodiments of the CARs of the disclosure, the transmembrane domain may comprise a sequence encoding a human CD8α transmembrane domain. In certain embodiments of the CARs/CLRs of the disclosure, the endodomain may comprise a human CD3ζ endodomain.

In certain embodiments of the CARs/CLRs of the disclosure, the at least one costimulatory domain may comprise a human 4-1BB, CD28, CD40, ICOS, MyD88, OX-40 intracellular segment, or any combination thereof. In certain embodiments of the CARs of the disclosure, the at least one costimulatory domain may comprise a CD28 and/or a 4-1BB costimulatory domain. In certain embodiments of the CARs of the disclosure, the hinge may comprise a sequence derived from a human CD8α, IgG4, and/or CD4 sequence. In certain embodiments of the CARs/CLRs of the disclosure, the hinge may comprise a sequence derived from a human CD8α sequence.

The CD28 costimulatory domain may comprise an amino acid sequence comprising RVKFSRSADAPA- YKQGQNQLYNELNLGRREEYDVLDKRR- GRDPEMGGKPRRKNPQ EGLYNELQKDKMAEAYSEI- GMKGERRRGKGHDGLYQGLSIATKDTYDALHMQ- ALP PR (SEQ ID NO: 17004) or a sequence having at least 70%, 80%, 90%, 95%, or 99% identity to the amino acid sequence comprising RVKFSRSADAPAYKQGQNQLY- NELNLGRREEYDVLDKRRGRDPEMGGKPRRKNPQ EGLYNELQKDKMAEAYSEIGMKGERRRGKGHDG- LYQGLSTAIKDTYDALHMQALP PR (SEQ ID NO: 17004). The CD28 costimulatory domain may be encoded by the nucleic acid sequence comprising cgcgtgaagtttagtc- gatcagcagatgcccagctta- caaacagggacagaaccagctgtataacgagctgaatctgggccgccga gag- gaatatgacgtgctggataagcggagaggacgcgaccccgaaatgggag- gcaagcccaggcgcaaaaaccctcaggaagg cctgtataacgagctgcagaaggacaaaatggcagaagcctattctgagatcgg- catgaaggggagcgacggagaggcaaagg gcac- gatgggctgtaccagggactgagcaccgccacaaaggacacctatgatgctctg- catatgcaggcactgcctccaagg (SEQ ID NO: 17005). The 4-1BB costimulatory domain may comprise an amino acid sequence comprising KRGRKKLLY- IFKQPFMRPVQTTQEEDGCSCRFPEEEEGGCEL (SEQ ID NO: 17006) or a sequence having at least 70%, 80%, 90%, 95%, or 99% identity to the amino acid sequence comprising (SEQ ID NO: 17006)
KRGRKKLLYIFKQPFMRPVQTTQEEDGCSCRFPEEEEGGCEL.

The 4-1BB costimulatory domain may be encoded by the nucleic acid sequence comprising aagagaggcag- gaagaaactgctgtatattttcaaacagcccttcatgcgccccgtgcagac- tacccaggaggaagacgggtgctcc tgtcgattccctgaggaagag- gaaggcgggtgtgagctg (SEQ ID NO: 17007) The 4-1BB costimulatory domain may be located between the transmembrane domain and the CD28 costimulatory domain.

In certain embodiments of the CARs/CLRs of the disclosure, the hinge may comprise a sequence derived from a human CD8α, IgG4, and/or CD4 sequence. In certain embodiments of the CARs/CLRs of the disclosure, the hinge may comprise a sequence derived from a human CD8α sequence. The hinge may comprise a human CD8α amino acid sequence comprising TTTPAPRPPTPAPTIA- SQPLSLRPEACRPAAGGAVHTRGLDFACD (SEQ ID NO: 17008) or a sequence having at least 70%, 80%, 90%, 95%, or 99% identity to the amino acid sequence comprising (SEQ ID NO: 17008)
TTTPAPRPPTPAPTIASQPLSLRPEACRPAAGGAVHTRGLDFACD.

The human CD8α hinge amino acid sequence may be encoded by the nucleic acid sequence comprising (SEQ ID NO: 17028)
actaccacaccagcacctagaccaccaactccagctccaaccatc gcgagtcagcccctgagtctgagacctgaggcctgcaggccagct gcaggaggagctgtgcacaccaggggcctggacttcgcctgcgac.

ScFv

The disclosure provides single chain variable fragment (scFv) compositions and methods for use of these compositions to recognize and bind to a specific target protein. ScFv compositions comprise a heavy chain variable region and a light chain variable region of an antibody. ScFv compositions may be incorporated into an antigen/ligand recognition region of a CAR or CLR of the disclosure. An antigen/ligand recognition region of a CAR or CLR of the disclosure may comprise an ScFv or an ScFv composition of the disclosure. In some embodiments, ScFvs comprise fusion proteins of the variable regions of the heavy (VH) and light (VL) chains of an immunoglobulin, wherein the VH and VL domains are connected with a linker. ScFvs retain the specificity of the original immunoglobulin, despite removal of the constant regions and the introduction of the linker. An exemplary linker comprises a sequence of GGGGSGGGGSGGGGS (SEQ ID NO: 17033).

Centyrins

Centyrins of the disclosure specifically bind to an antigen or a ligand of the disclosure. CARs and/or CLRs of the disclosure comprising one or more Centyrins that specifically bind an antigen may be used to direct the specificity of a cell, (e.g. a cytotoxic immune cell) towards a cell expressing the specific antigen. Alternatively or in addition, CLRs of the disclosure comprising a Centyrin that specifically binds a ligand antigen may transduce a signal intracellularly to induce expression of a sequence under the control of an inducible promoter.

Centyrins of the disclosure may comprise a protein scaffold, wherein the scaffold is capable of specifically binding an antigen or a ligand. Centyrins of the disclosure may comprise a protein scaffold comprising a consensus sequence of at least one fibronectin type III (FN3) domain, wherein the scaffold is capable of specifically binding an antigen or a ligand. The at least one fibronectin type III (FN3) domain may be derived from a human protein. The human protein may be Tenascin-C. The consensus sequence may comprise (SEQ ID NO: 17010)
LPAPKNLVVSEVTEDSLRLSWTAPDAAFDSFLIQYQESEKVGEAI NLTVPGSERSYDLTGLKPGTEYTVSIYGVKGGHRSNPLSAEFTT
or
(SEQ ID NO: 17011)
MLPAPKNLVVSEVTEDSLRLSWTAPDAAFDSFLIQYQESEKVGEA

INLTVPGSERSYDLTGLKPGTEYTVSFYGVKGGHRSNPLSAEFTT.

A Centyrin may comprise an amino sequence having at least 50%, 55%, 60% 65%, 70%, 75%, 80%, 85%, 90%, 95%, 97%, 99% or any percentage in between of identity to the sequence of (SEQ ID NO: 17010)
LPAPKNLVVSEVTEDSLRLSWTAPDAAFDSFLIQYQESEKVGEAI NLTVPGSERSYDLTGLKPGTEYTVSIYGVKGGHRSNPLSAEFTT
or
(SEQ ID NO: 17011)
MLPAPKNLVVSEVTEDSLRLSWTAPDAAFDSFLIQYQESEKVGEA

INLTVPGSERSYDLTGLKPGTEYTVS1YGVKGGHRSNPLSAEFTT.

A Centyrin may comprise an amino sequence having at least 74% identity to the sequence of (SEQ ID NO: 17010)
LPAPKNLVVSEVTEDSLRLSWTAPDAAFDSFLIQYQESEKVGEAI NLTVPGSERSYDLTGLKPGTEYTVSIYGVKGGHRSNPLSAEFTT
or (SEQ ID NO: 17011)
MLPAPKNLVVSEVTEDSLRLSWTAPDAAFDSFLIQYQESEKVGEA

INLTVPGSERSYDLTGLKPGTEYTVSIYGVKGGHRSNPLSAEFTT.

The consensus sequence may encoded by a nucleic acid sequence comprising (SEQ ID NO: 17034)
atgctgcctgcaccaaagaacctggtggtgtctcatgtgacagagg atagtgccagactgtcatggactgctcccgacgcagccttcgatag ttttatcatcgtgtaccgggagaacatcgaaaccggcgaggccatt gtcctgacagtgccagggtccgaacgctcttatgacctgacagatc tgaagcccggaactgagtactatgtgcagatcgccggcgtcaaagg aggcaatatcagcttccctctgtccgcaatcttcaccaca.

The consensus sequence may be modified at one or more positions within (a) a A-B loop comprising or consisting of the amino acid residues TEDS (SEQ ID NO: 17035) at positions 13-16 of the consensus sequence; (b) a B-C loop comprising or consisting of the amino acid residues TAPDAAF (SEQ ID NO: 17036) at positions 22-28 of the consensus sequence; (c) a C-D loop comprising or consisting of the amino acid residues SEKVGE (SEQ ID NO: 17037) at positions 38-43 of the consensus sequence; (d) a D-E loop comprising or consisting of the amino acid residues GSER (SEQ ID NO: 17038) at positions 51-54 of the consensus sequence; (e) a E-F loop comprising or consisting of the amino acid residues GLKPG (SEQ ID NO: 17039) at positions 60-64 of the consensus sequence; (f) a F-G loop comprising or consisting of the amino acid residues KGGHRSN (SEQ ID NO: 17040) at positions 75-81 of the consensus sequence; or (g) any combination of (a)-(f). Centyrins of the disclosure may comprise a consensus sequence of at least 5 fibronectin type III (FN3) domains, at least 10 fibronectin type III (FN3) domains or at least 15 fibronectin type III (FN3) domains.

The Centyrin may bind an antigen or a ligand with at least one affinity selected from a $K_D$ of less than or equal to $10^{-9}$M, less than or equal to $10^{-10}$M, less than or equal to $10^{-11}$M, less than or equal to $10^{-12}$M, less than or equal to $10^{-13}$M, less than or equal to $10^{-14}$M, and less than or equal to $10^{-15}$M. The $K_D$ may be determined by surface plasmon resonance.

Antibody Mimetic

The term "antibody mimetic" is intended to describe an organic compound that specifically binds a target sequence and has a structure distinct from a naturally-occurring antibody. Antibody mimetics may comprise a protein, a nucleic acid, or a small molecule. The target sequence to which an antibody mimetic of the disclosure specifically binds may be an antigen. Antibody mimetics may provide superior properties over antibodies including, but not limited to, superior solubility, tissue penetration, stability towards heat and enzymes (e.g. resistance to enzymatic degradation), and lower production costs. Exemplary antibody mimetics include, but are not limited to, an affibody, an afflilin, an affimer, an affitin, an alphabody, an anticalin, and avimer (also known as avidity multimer), a DARPin (Designed Ankyrin Repeat Protein), a Fynomer, a Kunitz domain peptide, and a monobody.

Affibody molecules of the disclosure comprise a protein scaffold comprising or consisting of one or more alpha helix without any disulfide bridges. Preferably, affibody molecules of the disclosure comprise or consist of three alpha helices. For example, an affibody molecule of the disclosure may comprise an immunoglobulin binding domain. An affibody molecule of the disclosure may comprise the Z domain of protein A.

Affilin molecules of the disclosure comprise a protein scaffold produced by modification of exposed amino acids of, for example, either gamma-B crystallin or ubiquitin. Affilin molecules functionally mimic an antibody's affinity to antigen, but do not structurally mimic an antibody. In any protein scaffold used to make an affilin, those amino acids that are accessible to solvent or possible binding partners in a properly-folded protein molecule are considered exposed amino acids. Any one or more of these exposed amino acids may be modified to specifically bind to a target sequence or antigen.

Affimer molecules of the disclosure comprise a protein scaffold comprising a highly stable protein engineered to display peptide loops that provide a high affinity binding site for a specific target sequence. Exemplary affimer molecules of the disclosure comprise a protein scaffold based upon a cystatin protein or tertiary structure thereof. Exemplary affimer molecules of the disclosure may share a common tertiary structure of comprising an alpha-helix lying on top of an anti-parallel beta-sheet.

Affitin molecules of the disclosure comprise an artificial protein scaffold, the structure of which may be derived, for example, from a DNA binding protein (e.g. the DNA binding protein Sac7d). Affitins of the disclosure selectively bind a target sequence, which may be the entirety or part of an antigen. Exemplary affitins of the disclosure are manufactured by randomizing one or more amino acid sequences on the binding surface of a DNA binding protein and subjecting the resultant protein to ribosome display and selection. Target sequences of affitins of the disclosure may be found, for example, in the genome or on the surface of a peptide, protein, virus, or bacteria. In certain embodiments of the disclosure, an affitin molecule may be used as a specific inhibitor of an enzyme. Affitin molecules of the disclosure may include heat-resistant proteins or derivatives thereof.

Alphabody molecules of the disclosure may also be referred to as Cell-Penetrating Alphabodies (CPAB). Alphabody molecules of the disclosure comprise small proteins (typically of less than 10 kDa) that bind to a variety of target sequences (including antigens). Alphabody molecules are capable of reaching and binding to intracellular target sequences. Structurally, alphabody molecules of the disclosure comprise an artificial sequence forming single chain alpha helix (similar to naturally occurring coiled-coil structures). Alphabody molecules of the disclosure may comprise a protein scaffold comprising one or more amino acids that are modified to specifically bind target proteins. Regardless of the binding specificity of the molecule, alphabody molecules of the disclosure maintain correct folding and thermostability.

Anticalin molecules of the disclosure comprise artificial proteins that bind to target sequences or sites in either proteins or small molecules. Anticalin molecules of the disclosure may comprise an artificial protein derived from a human lipocalin. Anticalin molecules of the disclosure may be used in place of, for example, monoclonal antibodies or fragments thereof. Anticalin molecules may demonstrate superior tissue penetration and thermostability than monoclonal antibodies or fragments thereof. Exemplary anticalin molecules of the disclosure may comprise about 180 amino acids, having a mass of approximately 20 kDa. Structurally, anticalin molecules of the disclosure comprise a barrel structure comprising antiparallel beta-strands pairwise connected by loops and an attached alpha helix. In preferred embodiments, anticalin molecules of the disclosure comprise a barrel structure comprising eight antiparallel beta-strands pairwise connected by loops and an attached alpha helix.

Avimer molecules of the disclosure comprise an artificial protein that specifically binds to a target sequence (which may also be an antigen). Avimers of the disclosure may recognize multiple binding sites within the same target or within distinct targets. When an avimer of the disclosure recognize more than one target, the avimer mimics function of a bi-specific antibody. The artificial protein avimer may comprise two or more peptide sequences of approximately 30-35 amino acids each. These peptides may be connected via one or more linker peptides. Amino acid sequences of one or more of the peptides of the avimer may be derived from an A domain of a membrane receptor. Avimers have a rigid structure that may optionally comprise disulfide bonds and/or calcium. Avimers of the disclosure may demonstrate greater heat stability compared to an antibody.

DARPins (Designed Ankyrin Repeat Proteins) of the disclosure comprise genetically-engineered, recombinant, or chimeric proteins having high specificity and high affinity for a target sequence. In certain embodiments, DARPins of the disclosure are derived from ankyrin proteins and, optionally, comprise at least three repeat motifs (also referred to as repetitive structural units) of the ankyrin protein. Ankyrin proteins mediate high-affinity protein-protein interactions. DARPins of the disclosure comprise a large target interaction surface.

Fynomers of the disclosure comprise small binding proteins (about 7 kDa) derived from the human Fyn SH3 domain and engineered to bind to target sequences and molecules with equal affinity and equal specificity as an antibody.

Kunitz domain peptides of the disclosure comprise a protein scaffold comprising a Kunitz domain. Kunitz domains comprise an active site for inhibiting protease activity. Structurally, Kunitz domains of the disclosure comprise a disulfide-rich alpha+beta fold. This structure is exemplified by the bovine pancreatic trypsin inhibitor. Kunitz domain peptides recognize specific protein structures and serve as competitive protease inhibitors. Kunitz domains of the disclosure may comprise Ecallantide (derived from a human lipoprotein-associated coagulation inhibitor (LACI)).

Monobodies of the disclosure are small proteins (comprising about 94 amino acids and having a mass of about 10 kDa) comparable in size to a single chain antibody. These genetically engineered proteins specifically bind target sequences including antigens. Monobodies of the disclosure may specifically target one or more distinct proteins or target sequences. In preferred embodiments, monobodies of the disclosure comprise a protein scaffold mimicking the structure of human fibronectin, and more preferably, mimicking the structure of the tenth extracellular type III domain of fibronectin. The tenth extracellular type III domain of fibronectin, as well as a monobody mimetic thereof, contains seven beta sheets forming a barrel and three exposed loops on each side corresponding to the three complementarity determining regions (CDRs) of an antibody. In contrast to the structure of the variable domain of an antibody, a monobody lacks any binding site for metal ions as well as a central disulfide bond. Multispecific monobodies may be optimized by modifying the loops BC and FG. Monobodies of the disclosure may comprise an adnectin.

VHH

In certain embodiments of the compositions and methods of the disclosure, a CAR or a CLR comprises a single domain antibody (SdAb). In certain embodiments, the SdAb is a VHH.

The disclosure provides a CAR or a CLR comprising an antigen or ligand recognition region, respectively, that comprises at least one VHH (to produce a "VCAR" or "VCLR"). CARs and CLRs of the disclosure may comprise more than one VHH. For example, a bi-specific VCAR or VCLR may comprise two VHHs. In some embodiments of the bi-specific VCAR or VCLR, each VHH specifically binds a distinct antigen.

VHH proteins of the disclosure specifically bind an antigen or a ligand. CARs of the disclosure comprising one or more VHHs that specifically bind an antigen may be used to direct the specificity of a cell, (e.g. a cytotoxic immune cell) towards a target cell expressing the specific antigen. CLRs of the disclosure comprising one or more VHHs that specifically bind an antigen may transduce an intracellular signal upon binding a ligand of either VHH to activate expression of a sequence under the control of an inducible promoter.

Sequences encoding a VHH of the disclosure can be altered, added and/or deleted to reduce immunogenicity or reduce, enhance or modify binding, affinity, on-rate, off-rate, avidity, specificity, half-life, stability, solubility or any other suitable characteristic, as known in the art.

Optionally, VHH proteins can be engineered with retention of high affinity for the antigen or ligand and other favorable biological properties. To achieve this goal, the VHH proteins can be optionally prepared by a process of analysis of the parental sequences and various conceptual engineered products using three-dimensional models of the parental and engineered sequences. Three-dimensional models are commonly available and are familiar to those skilled in the art. Computer programs are available which illustrate and display probable three-dimensional conformational structures of selected candidate sequences and can measure possible immunogenicity (e.g., Immunofilter program of Xencor, Inc. of Monrovia, Calif.). Inspection of these displays permits analysis of the likely role of the residues in the functioning of the candidate sequence. i.e., the analysis of residues that influence the ability of the candidate VHH protein to bind its antigen/ligand. In this way, residues can be selected and combined from the parent and reference sequences so that the desired characteristic, such as affinity for the target antigen(s)/ligand(s), is achieved. Alternatively, or in addition to, the above procedures, other suitable methods of engineering can be used.

VH

In certain embodiments of the compositions and methods of the disclosure, a CAR or a CLR comprises a single domain antibody (SdAb). In certain embodiments, the SdAb is a VH.

The disclosure provides CARs/CLRs comprising a single domain antibody (to produce a "VCAR" or a "VCLR", respectively). In certain embodiments, the single domain antibody comprises a VH. In certain embodiments, the VH is isolated or derived from a human sequence. In certain embodiments, VH comprises a human CDR sequence and/or a human framework sequence and a non-human or humanized sequence (e.g. a rat Fc domain). In certain embodiments, the VH is a fully humanized VH. In certain embodiments, the VH s neither a naturally occurring antibody nor a fragment of a naturally occurring antibody. In certain embodiments, the VH is not a fragment of a monoclonal antibody. In certain embodiments, the VH is a UniDab™ antibody (TeneoBio).

In certain embodiments, the VH is fully engineered using the UniRat™ (TeneoBio) system and "NGS-based Discovery" to produce the VH. Using this method, the specific VH are not naturally-occurring and are generated using fully engineered systems. The VH are not derived from naturally-occurring monoclonal antibodies (mAbs) that were either isolated directly from the host (for example, a mouse, rat or human) or directly from a single clone of cells or cell line (hybridoma). These VHs were not subsequently cloned from said cell lines. Instead, VH sequences are fully-engineered using the UniRat™ system as transgenes that comprise human variable regions (VH domains) with a rat Fc domain, and are thus human/rat chimeras without a light chain and are unlike the standard mAb format. The native rat genes are knocked out and the only antibodies expressed in the rat are from transgenes with VH domains linked to a Rat Fc (UniAbs). These are the exclusive Abs expressed in the UniRat. Next generation sequencing (NGS) and bioinformatics are used to identify the full antigen-specific repertoire of the heavy-chain antibodies generated by UniRat™ after immunization. Then, a unique gene assembly method is used to convert the antibody repertoire sequence information into large collections of fully-human heavy-chain antibodies that can be screened in vitro for a variety of functions. In certain embodiments, fully humanized VH are generated by fusing the human VH domains with human Fcs in vitro (to generate a non-naturally occurring recombinant VH antibody). In certain embodiments, the VH are fully humanized, but they are expressed in vivo as human/rat chimera (human VH, rat Fc) without a light chain. Fully humanized VHs are expressed in vivo as human/rat chimera (human VH, rat Fc) without a light chain are about 80 kDa (vs 150 kDa).

VCARs/VCLRs of the disclosure may comprise at least one VH of the disclosure. In certain embodiments, the VH of the disclosure may be modified to remove an Fc domain or a portion thereof. In certain embodiments, a framework sequence of the VH of the disclosure may be modified to, for example, improve expression, decrease immunogenicity or to improve function.

Transposons/Transposases

Exemplary transposon/transposase systems of the disclosure include, but are not limited to, piggyBac transposons and transposases, Sleeping Beauty transposons and transposases, Helraiser transposons and transposases and Tol2 transposons and transposases.

The piggyBac transposase recognizes transposon-specific inverted terminal repeat sequences (ITRs) on the ends of the transposon, and moves the contents between the ITRs into TTAA chromosomal sites. The piggyBac transposon system has no payload limit for the genes of interest that can be included between the ITRs. In certain embodiments, and, in particular, those embodiments wherein the transposon is a piggyBac transposon, the transposase is a piggyBac™ or a Super piggyBac™ (SPB) transposase. In certain embodiments, and, in particular, those embodiments wherein the transposase is a Super piggyBac™ (SPB) transposase, the sequence encoding the transposase is an mRNA sequence.

In certain embodiments of the methods of the disclosure, the transposase enzyme is a piggyBac™ (PB) transposase enzyme. The piggyBac (PB) transposase enzyme may comprise or consist of an amino acid sequence at least 75%, 80%, 85%, 90%, 95%, 99% or any percentage in between identical to:

(SEQ ID NO: 14487)

```
  1 MGSSLDDEHI LSALLQSDDE LVGEDSDSEI
    SDHVSEDDVQ SDTEEAFIDE VHEVQPTSSG
 61 SEILDEQNVT EQPGSSLASN RILTLPQRTI
    RGKNKHCWST SKSTRRSRVS ALNIVRSQRG
121 PTRMCRNIYD PLLCFKLFFT DEIISEIVKW
    TNAEISLKRR ESMTGATFRD TNEDEIYAFF
101 GILVMTAVRK DNHMSTDDLF DRSLSMVYVS
    VMSRDRFDFD IRCLRMDDKS IRPTLRENDV
241 FTPVRKIWDL FIHQCIQNYT PGAHLT1DEQ
    LLGFRGRCPF RMYIPNKPSK YGIKILMMCD
301 SGTKYMINGM PYLGRGTQTN GVPLGEYYVK
    ELSKPVHGSC RNITCDNWFT SIPIAKNLLQ
361 EPYKLTIVGT VRSNKREIPE VLKNSRSRPV
    GTSMFCFDGP LTLVSYKPKP AKMVYLLSSC
421 DEDASINEST GKPQMVMYYN QTKGGVDTLD
    QMCSVMTCSR KTNRWPMALL YGMINIACIN
481 SFIIYSHNVS SKGEKVQSRK KFMRNLYMSL
    TSSFMRKRLE APTLKRYLRD NISNILPNEV
541 PGTSDDSTEE PVMKKRTYCT YCPSKIRRKA
    NASCKKCKKV ICREHNIDMC QSCF.
```

In certain embodiments of the methods of the disclosure, the transposase enzyme is a piggyBac™ (PB) transposase enzyme that comprises or consists of an amino acid sequence having an amino acid substitution at one or more of positions 30, 165, 282, or 538 of the sequence:

(SEQ ID NO: 14487)

```
  1 MGSSLDDEHI LSALLQSDDE LVGEDSDSEI
    SDHVSEDDVQ SDTEEAFIDE VHEVQPTSSG
 61 SEILDEQNVI EQPGSSLASN RILTLPQRTI
    RGKNKHCWST SKSTRRSRVS ALNIVRSQRG
121 PTRMCRNIYD PLLCFKLFFT DEIISEIVKW
    TNAEISLKRR ESMTGATFRD TNEDEIYAFF
181 GILVMTAVRK DNHMSTDDLF DRSLSMVYVS
    VMSRDRFDFL IRCLRMDDKS IRPTLRENDV
241 FTPVRKIWDL FIHQCIQNYT PGAHLTIDEQ
    LLGFRGRCPF RMYIPNKPSK YGIKILMMCD
```

```
301 SGTKYMINGM PYLGRGTQTN GVPLGEYYVK

ELSKPVHGSC RNITCDNWFT SIPLAKNLLQ

361 EPYKLTIVGT VRSNKREIPE VLKNSRSRPV

GTSMFCFDGP LTLVSYKPKP AKMVYLLSSC

421 DEDASINEST GKPQMVMYYN QTKGGVDTLD

QMCSVMTCSR KTNRWPMALL YGMINIACIN

481 SFIIYSHNVS SKGEKVQSRK KFMRNLYMSL

TSSFMRKRLE APTLKRYLRD NISNILPNEV

541 PGTSDDSTEE PVMKKRTYCT YCPSKIRRKA

NASCKKCKKV ICREHNIDMC QSCF.
```

In certain embodiments, the transposase enzyme is a piggyBac™ (PB) transposase enzyme that comprises or consists of an amino acid sequence having an amino acid substitution at two or more of positions 30, 165, 282, or 538 of the sequence of SEQ ID NO: 14487. In certain embodiments, the transposase enzyme is a piggyBac™ (PB) transposase enzyme that comprises or consists of an amino acid sequence having an amino acid substitution at three or more of positions 30, 165, 282, or 538 of the sequence of SEQ ID NO: 14487. In certain embodiments, the transposase enzyme is a piggyBac™ (PB) transposase enzyme that comprises or consists of an amino acid sequence having an amino acid substitution at each of the following positions 30, 165, 282, and 538 of the sequence of SEQ ID NO: 14487. In certain embodiments, the amino acid substitution at position 30 of the sequence of SEQ ID NO: 14487 is a substitution of a valine (V) for an isoleucine (I). In certain embodiments, the amino acid substitution at position 165 of the sequence of SEQ ID NO: 14487 is a substitution of a serine (S) for a glycine (G). In certain embodiments, the amino acid substitution at position 282 of the sequence of SEQ ID NO: 14487 is a substitution of a valine (V) for a methionine (M). In certain embodiments, the amino acid substitution at position 538 of the sequence of SEQ ID NO: 14487 is a substitution of a lysine (K) for an asparagine (N).

In certain embodiments of the methods of the disclosure, the transposase enzyme is a Super piggyBac™ (SPB) transposase enzyme. In certain embodiments, the Super piggyBac™ (SPB) transposase enzymes of the disclosure may comprise or consist of the amino acid sequence of the sequence of SEQ ID NO: 14487 wherein the amino acid substitution at position 30 is a substitution of a valine (V) for an isoleucine (I), the amino acid substitution at position 165 is a substitution of a serine (S) for a glycine (G), the amino acid substitution at position 282 is a substitution of a valine (V) for a methionine (M), and the amino acid substitution at position 538 is a substitution of a lysine (K) for an asparagine (N). In certain embodiments, the Super piggyBac™ (SPB) transposase enzyme may comprise or consist of an amino acid sequence at least 75%, 80%, 85%, 90%, 95%, 99% or any percentage in between identical to:

```
                                  (SEQ ID NO: 14484)
  1 MGSSLDDEHI LSALLQSDDE LVGEDSDSEV

SDHVSEDDVQ SDTEEAFIDE VHEVQPTSSG

61 SEILDEQNVI EQPGSSLASN RILTLPQRTI

RGKNKHCWST SKSTRRSRVS ALNIVRSQRG

121 PTRMCRNIYD PLLCFKLFFT DEIISEIVKW

TNAEISLKRR ESMTSATFRD TNEDEIYAFF

181 GILVMTAVRK DNHMSTDDLF DRSLSMVYVS

VMSRDRFDFL IRCLRMDDKS IRPTLRENDV

241 FTPVRKIWDL FIHQCIQNYT PGAHLTIDEQ

LLGFRGRCPF RVYIPNKPSK YGIKILMMCD

301 SGTKYMINGM PYLGRGTQTN GVPLGEYYVK

ELSKPVHGSC RNITCDNWFT SIPLAKNLLQ

361 EPYKLTIVGT VRSNKREIPE VLKNSRSRPV

GTSMFCFDGP LTLVSYKPKP AKMVYLLSSC

421 DEDASINEST GKPQMVMYYN QTKGGVDTLD

QMCSVMTCSR KTNRWPMALL YGMINIACIN

481 SFIIYSHNVS SKGEKVQSRK KFMRNLYMSL

TSSFMRKRLE APTLKRYLRD NISNILPKEV

541 PGTSDDSTEE PVMKKRTYCT YCPSKIRRKA

NASCKKCKKV ICREHNIDMC QSCF.
```

In certain embodiments of the methods of the disclosure, including those embodiments wherein the transposase comprises the above-described mutations at positions 30, 165, 282 and/or 538, the piggyBac™ or Super piggyBac™ transposase enzyme may further comprise an amino acid substitution at one or more of positions 3, 46, 82, 103, 119, 125, 177, 180, 185, 187, 200, 207, 209, 226, 235, 240, 241, 243, 258, 296, 298, 311, 315, 319, 327, 328, 340, 421, 436, 456, 470, 486, 503, 552, 570 and 591 of the sequence of SEQ ID NO: 14487 or SEQ ID NO: 14484. In certain embodiments, including those embodiments wherein the transposase comprises the above-described mutations at positions 30, 165, 282 and/or 538, the piggyBac™ or Super piggyBac™ transposase enzyme may further comprise an amino acid substitution at one or more of positions 46, 119, 125, 177, 180, 185, 187, 200, 207, 209, 226, 235, 240, 241, 243, 296, 298, 311, 315, 319, 327, 328, 340, 421, 436, 456, 470, 485, 503, 552 and 570. In certain embodiments, the amino acid substitution at position 3 of SEQ ID NO: 14487 or SEQ ID NO: 14484 is a substitution of an asparagine (N) for a serine (S). In certain embodiments, the amino acid substitution at position 46 of SEQ ID NO: 14487 or SEQ ID NO: 14484 is a substitution of a serine (S) for an alanine (A). In certain embodiments, the amino acid substitution at position 46 of SEQ ID NO: 14487 or SEQ ID NO: 14484 is a substitution of a threonine (T) for an alanine (A). In certain embodiments, the amino acid substitution at position 82 of SEQ ID NO: 14487 or SEQ ID NO: 14484 is a substitution of a tryptophan (W) for an isoleucine (I). In certain embodiments, the amino acid substitution at position 103 of SEQ ID NO: 14487 or SEQ ID NO: 14484 is a substitution of a proline (P) for a serine (S). In certain embodiments, the amino acid substitution at position 119 of SEQ ID NO: 14487 or SEQ ID NO: 14484 is a substitution of a proline (P) for an arginine (R). In certain embodiments, the amino acid substitution at position 125 of SEQ ID NO: 14487 or SEQ ID NO: 14484 is a substitution of an alanine (A) a cysteine (C). In certain embodiments, the amino acid substitution at position 125 of SEQ ID NO: 14487 or SEQ ID NO: 14484 is a substitution of a leucine (L) for a cysteine (C). In certain embodiments, the amino acid substitution at position 177 of SEQ ID NO: 14487 or SEQ ID NO: 14484 is a substitution of a lysine (K) for a tyrosine (Y). In certain embodiments, the amino acid substitution at position 177 of SEQ ID NO: 14487 or SEQ ID NO: 14484 is a substitution of a histidine (H) for a tyrosine (Y). In certain embodiments, the amino acid substitution at position 180 of SEQ ID NO: 14487 or SEQ ID NO: 14484 is a substitution of a leucine (L) for a phenylalanine (F). In certain embodiments, the amino acid substitution at position 180 of SEQ ID NO: 14487 or SEQ ID NO: 14484 is a substitution of an isoleucine (I) for a phenylalanine (F). In certain embodiments, the amino acid substitution at position 180 of SEQ ID NO: 14487 or SEQ ID NO: 14484 is a substitution of a valine (V) for a phenylalanine (F). In certain embodiments, the amino acid substitution at position 185 of SEQ ID NO: 14487 or SEQ ID NO: 14484 is a substitution of a leucine (L) for a methionine (M). In certain embodiments, the amino acid substitution at position 187 of SEQ ID NO: 14487 or SEQ ID NO: 14484 is a substitution of a glycine (G) for an alanine (A). In certain embodiments, the amino acid substitution at position 200 of SEQ ID NO: 14487 or SEQ ID NO: 14484 is a substitution of a tryptophan (W) for a phenylalanine (F). In certain embodiments, the amino acid substitution at position 207 of SEQ ID NO: 14487 or SEQ ID NO: 14484 is a substitution of a proline (P) for a valine (V). In certain embodiments, the amino acid substitution at position 209 of SEQ ID NO: 14487 or SEQ ID NO: 14484 is a substitution of a phenylalanine (F) for a valine (V). In certain embodiments, the amino acid substitution at position 226 of SEQ ID NO: 14487 or SEQ ID NO: 14484 is a substitution of a phenylalanine (F) for a methionine (M). In certain embodiments, the amino acid substitution at position 235 of SEQ ID NO: 14487 or SEQ ID NO: 14484 is a substitution of an arginine (R) for a leucine (L). In certain embodiments, the amino acid substitution at position 240 of SEQ ID NO: 14487 or SEQ ID NO: 14484 is a substitution of a lysine (K) for a valine (V). In certain embodiments, the amino acid substitution at position 241 of SEQ ID NO: 14487 or SEQ ID NO: 14484 is a substitution of a leucine (L) for a phenylalanine (F). In certain embodiments, the amino acid substitution at position 243 of SEQ ID NO: 14487 or SEQ ID NO: 14484 is a substitution of a lysine (K) for a proline (P). In certain embodiments, the amino acid substitution at position 258 of SEQ ID NO: 14487 or SEQ ID NO: 14484 is a substitution of a serine (S) for an asparagine (N). In certain embodiments, the amino acid substitution at position 296 of SEQ ID NO: 14487 or SEQ ID NO: 14484 is a substitution of a tryptophan (W) for a leucine (L). In certain embodiments, the amino acid substitution at position 296 of SEQ ID NO: 14487 or SEQ ID NO: 14484 is a substitution of a tyrosine (Y) for a leucine (L). In certain embodiments, the amino acid substitution at position 296 of SEQ ID NO: 14487 or SEQ ID NO: 14484 is a substitution of a phenylalanine (F) for a leucine (I.) In certain embodiments, the amino acid substitution at position 298 of SEQ ID NO 14487 or SEQ ID NO: 14484 is a substitution of a leucine (L) for a methionine (M). In certain embodiments, the amino acid substitution at position 298 of SEQ ID NO: 14487 or SEQ ID NO: 14484 is a substitution of an alanine (A) for a methionine (M). In certain embodiments, the amino acid substitution at position 298 of SEQ ID NO: 14487 or SEQ ID NO: 14484 is a substitution of a valine (V) for a methionine (M). In certain embodiments, the amino acid substitution at position 311 of SEQ ID NO: 14487 or SEQ ID NO: 14484 is a substitution of an isoleucine (I) for a proline (P) In certain embodiments, the amino acid substitution at position 311 of SEQ ID NO: 14487 or SEQ ID NO: 14484 is a substitution of a valine for a proline (P). In certain embodiments, the amino acid substitution at position 315 of SEQ ID NO: 14487 or SEQ ID NO: 14484 is a substitution of a lysine (K) for an arginine (R). In certain embodiments, the amino acid substitution at position 319 of SEQ ID NO: 14487 or SEQ ID NO: 14484 is a substitution of a glycine (G) for a threonine (T). In certain embodiments, the amino acid substitution at position 327 of SEQ ID NO: 14487 or SEQ ID NO: 14484 is a substitution of an arginine (R) for a tyrosine (Y). In certain embodiments, the amino acid substitution at position 328 of SEQ ID NO: 14487 or SEQ ID NO: 14484 is a substitution of a valine (V) for a tyrosine (Y). In certain embodiments, the amino acid substitution at position 340 of SEQ ID NO: 14487 or SEQ ID NO: 14484 is a substitution of a glycine (G) for a cysteine (C). In certain embodiments, the amino acid substitution at position 340 of SEQ ID NO: 14487 or SEQ ID NO: 14484 is a substitution of a leucine (L) for a cysteine (C). In certain embodiments, the amino acid substitution at position 421 of SEQ ID NO: 14487 or SEQ ID NO: 14484 is a substitution of a histidine (H) for the aspartic acid (D). In certain embodiments, the amino acid substitution at position 436 of SEQ ID NO: 14487 or SEQ ID NO: 14484 is a substitution of an isoleucine (I) for a valine (V). In certain embodiments, the amino acid substitution at position 456 of SEQ ID NO: 14487 or SEQ ID NO: 14484 is a substitution of a tyrosine (Y) for a methionine (M). In certain embodiments, the amino acid substitution at position 470 of SEQ ID NO: 14487 or SEQ ID NO: 14484 is a substitution of a phenylalanine (F) for a leucine (L). In certain embodiments, the amino acid substitution at position 485 of SEQ ID NO: 14487 or SEQ ID NO: 14484 is a substitution of a lysine (K) for a serine (S). In certain embodiments, the amino acid substitution at position 503 of SEQ ID NO: 14487 or SEQ ID NO: 14484 is a substitution of a leucine (L) for a methionine (M). In certain embodiments, the amino acid substitution at position 503 of SEQ ID NO: 14487 or SEQ ID NO: 14484 is a substitution of an isoleucine (I) for a methionine (M). In certain embodiments, the amino acid substitution at position 552 of SEQ ID NO: 14487 or SEQ ID NO: 14484 is a substitution of a lysine (K) for a valine (V). In certain embodiments, the amino acid substitution at position 570 of SEQ ID NO: 14487 or SEQ ID NO: 14484 is a substitution of a threonine (T) for an alanine (A). In certain embodiments, the amino acid substitution at position 591 of SEQ ID NO: 14487 or SEQ ID NO: 14484 is a substitution of a proline (P) for a glutamine (Q). In certain embodiments, the amino acid substitution at position 591 of SEQ ID NO: 14487 or SEQ ID NO: 14484 is a substitution of an arginine (R) for a glutamine (Q).

In certain embodiments of the methods of the disclosure, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at one or more of positions 103, 194, 372, 375, 450, 509 and 570 of the sequence of SEQ ID NO: 14487 or SEQ ID NO: 14484. In certain embodiments of the methods of the disclosure, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at two, three, four, five, six or more of positions 103, 194, 372, 375, 450, 509 and 570 of the sequence of SEQ ID NO: 14487 or SEQ ID NO: 14484. In certain embodiments, including those embodiments wherein the transposase comprises the above-described mutations at positions 30, 165, 282 and/or 538, the piggyBac™ transposase enzyme may comprise or the Super piggyBac™ transposase enzyme may further comprise an amino acid substitution at positions 103, 194, 372, 375, 450, 509 and 570 of the sequence of SEQ ID NO: 14487 or SEQ ID NO: 14484. In certain embodiments, the amino acid substitution at position 103 of SEQ ID NO: 14487 or SEQ ID NO: 14484 is a substitution of a proline (P) for a serine (S). In certain embodiments, the amino acid substitution at position 194 of SEQ ID NO: 14487 or SEQ ID NO: 14484 is a substitution of a valine (V) for a methionine (M). In certain embodiments, the amino acid substitution at position 372 of SEQ ID NO: 14487 or SEQ ID NO: 14484 is a substitution of an alanine (A) for an arginine (R). In certain embodiments, the amino acid substitution at position 375 of SEQ ID NO: 14487 or SEQ ID NO: 14484 is a substitution of an alanine (A) for a lysine (K). In certain embodiments, the amino acid substitution at position 450 of SEQ ID NO: 14487 or SEQ ID NO: 14484 is a substitution of an asparagine (N) for an aspartic acid (D). In certain embodiments, the amino acid substitution at position 509 of SEQ ID NO: 14487 or SEQ ID NO: 14484 is a substitution of a glycine (G) for a serine (S). In certain embodiments, the amino acid substitution at position 570 of SEQ ID NO: 14487 or SEQ ID NO: 14484 is a substitution of a serine (S) for an asparagine (N). In certain embodiments, the piggyBac™ transposase enzyme may comprise a substitution of a valine (V) for a methionine (M) at position 194 of SEQ ID NO: 14487. In certain embodiments, including those embodiments wherein the piggyBac™ transposase enzyme may comprise a substitution of a valine (V) for a methionine (M) at position 194 of SEQ ID NO: 14487, the piggyBac™ transposase enzyme may further comprise an amino acid substitution at positions 372, 375 and 450 of the sequence of SEQ ID NO: 14487 or SEQ ID NO: 14484. In certain embodiments, the piggyBac™ transposase enzyme may comprise a substitution of a valine (V) for a methionine (M) at position 194 of SEQ ID NO: 14487, a substitution of an alanine (A) for an arginine (R) at position 372 of SEQ ID NO: 14487, and a substitution of an alanine (A) for a lysine (K) at position 375 of SEQ ID NO: 14487. In certain embodiments, the piggyBac™ transposase enzyme may comprise a substitution of a valine (V) for a methionine (M) at position 194 of SEQ ID NO: 14487, a substitution of an alanine (A) for an arginine (R) at position 372 of SEQ ID NO: 14487, a substitution of an alanine (A) for a lysine (K) at position 375 of SEQ ID NO: 14487 and a substitution of an asparagine (N) for an aspartic acid (D) at position 450 of SEQ ID NO: 14487.

The sleeping beauty transposon is transposed into the target genome by the Sleeping Beauty transposase that recognizes ITRs, and moves the contents between the ITRs into TA chromosomal sites. In various embodiments, SB transposon-mediated gene transfer, or gene transfer using any of a number of similar transposons, may be used in the compositions and methods of the disclosure.

In certain embodiments, and, in particular, those embodiments wherein the transposon is a Sleeping Beauty transposon, the transposase is a Sleeping Beauty transposase or a hyperactive Sleeping Beauty transposase (SB100X).

In certain embodiments of the methods of the disclosure, the Sleeping Beauty transposase enzyme comprises an amino acid sequence at least 75%, 80%, 85%, 90%, 95%, 99% or any percentage in between identical to:

```
                                    (SEQ ID NO: 14485)
  1 MGKSKEISQD LRKKIVDLHK SGSSLGAISK

RLKVPRSSVQ TIVRXYKHHG TTQPSYRSGR

61 RRVLSPRDER TLVRKVQINP RTTAKDLVKM

LEETGTKVSI STVKRVLYRH NLKGRSARKK

121 PLLQNRHKKA RLRFATAHGD KDRTFWRNVL

WSDETKIELF GHNDHRYVWR KKGEACKPKN

181 TIPTVKHGGG SIMLWGCFAA GGTGALHKID

GIMRKENYVD ILKQHLKTSV RKLKLGRKWV

241 FQMDNDPKHT SKVVAKWLKD NKVKVLEWPS

QSPDLNPIEN LWAELKKRVR ARRPTNLTQL

301 HQLCQEEWAK IHPTYCGKLV EGYPKRLTQV

KQFKGNATKY.
```

In certain embodiments of the methods of the disclosure, the hyperactive Sleeping Beauty (SB100X) transposase enzyme comprises an amino acid sequence at least 75%, 80%, 85%, 90%, 95%, 99% or any percentage in between identical to:

```
                                    (SEQ ID NO: 14486)
  1 KGKSKEISQD LRKRIVDLHK SGSSLGAISK

RLAVPRSSVQ TIVRKYKHHG TTQPSYRSGR

61 RRVLSPRDER TLVRKVQINP RTTAKDLVKM

LEETGTKVSI STVKRVLYRH NLKGHSARKK

121 PLLQNRHKKA RLRFATAHGD KDRTFWRNVL

WSDETKIELF GHNDHRYVWR KKGEACKPKN

181 TIPTVKHGGG SIMLWGCFAA GGTGALHKID

GIMDAVQYVD ILKQHLKTSV RKLKLGRKWV

241 FQHDNDPKHT SKVVAKWLKD NKVKVLEWPS

QSPDLNPIEN LWAELKKRVR ARRPTNLTQL

301 HQLCQEEWAK IHPNYCGKLV EGYPKRLTQV

KQFKGNATKY.
```

The Helraiser transposon is transposed by the Helitron transposase. Helitron transposases mobilize the Helraiser transposon, an ancient element from the bat genome that was active about 30 to 36 million years ago. An exemplary Helraiser transposon of the disclosure includes Helibat1, which comprises a nucleic acid sequence comprising:

```
                                    (SEQ ID NO: 14652)
  1 TCCTATATAA TAAAAGAGAA ACATGCAAAT TGACCATCCC TCCGCTACGC TCAAGCCACG

61 CCCACCAGCC AATCAGAAGT GACTATGCAA ATTAACCCAA CAAAGATGGC AGTTAAATTT

121 GCATACGCAG GTGTCAAGCG CCCCAGGAGG CAACGGCGGC CGCGGGCTCC CAGGACCTTG
```

-continued

```
 181 GCTGGCCCCG GGAGGCGAGG CCGGCCGCGC CTAGCCACAC CCGCGGGCTC CCGGGACCTT
 241 CGCCAGCAGA GAGCAGAGCG GGAGAGCGGG CGGAGAGCGG GAGGTTTGGA GGACTTGGCA
 301 GAGCAGGAGG CCGCTGGACA TAGAGCAGAG CGAGAGAGAG GGTGGCTTGG AGGGCGTGGC
 361 TCCCTCTGTC ACCCCAGCTT CCTCATCACA GCTGTGaAAA CTGACAGCAG GGAGGAGGAA
 421 GTCCCACCCC CACAGAATCA GCCAGAATCA GCCGTTGGTC AGACAGCTCT CAGCGGCCTG
 481 ACAGCCAGGA CTCTCATTCA CCTGCATCTC AGACCGTGAC AGTAGAGAGG TGGGACTATG
 541 TCTAAAGAAC AACTGTTGAT ACAACGTAGC TCTGCAGCCG AAAGATGCCG GCGTTATCGA
 601 CAGAAAATGT CTGCAGAGCA ACGTGCGTCT GATCTTGAAA GAAGGCGGCG CCTGCAACAG
 661 AATGTATCTG AAGAGCAGCT ACTGGAAAAA CGTCGCTCTG AAGCCGAAAA ACAGCGGCGT
 721 CATCGACAGA AATGTCTAA AGACCAACGT GCCTTTGAAG TTGAAAGAAG GCGGTGGCGA
 781 CGACAGAATA TGTCTAGAGA ACAGTCATCA ACAAGTACTA CCAATACCGG TAGGAACTGC
 641 CTTCTCAGCA AAAATGGAGT ACATGAGGAT GCAATTCTCG AACATAGTTG TGGTGGAATG
 901 ACTGTTCGAT GTGAATTTTG CCTATCACTA AATTTCTCTG ATGAAAAACC ATCCGATGGG
 961 AAATTTACTC GATGTTGTAG CAAAGGGAAA GTCTGTCCAA ATGATATACA TTTTCCAGAT
1021 TACCCGGCAT ATTTAAAAAG ATTAATGACA AACGAAGATT CTGACAGTAA AAATTTCATG
1081 GAAATATTC GTTCCATAAA TAGTTCTTTT GCTTTTGCTT CCATGGGTGC AAATATTGCA
1141 TCGCCATCAG GATATGGGCC ATACTGTTTT AGAATACACG GACAAGTTTA TCACCGTACT
1201 GGAACTTTAC ATCCTTCGGA TGGTGTTTCT CGGAAGTTTG CTCAACTCTA TATTTTGGAT
1261 ACAGCCGAAG CTACAAGTAA AAGATTAGCA ATGCCAGAAA ACCAGGGCTG CTCAGAAAGA
1321 CTCATGATCA ACATCAACAA CCTCATGCAT GAAATAAATG AATTAAGAAA ATCGTACAAG
1381 ATGCTACATG AGGTAGAAAA GGAAGCCCAA TCTGAAGCAG CAGCAAAAGG TATTGCTCCC
1441 ACAGAAGTAA CAATGGCGAT TAAATACGAT CGTAACAGTG ACCCAGGTAG ATATAATTCT
1501 CCCCGTGTAA CCGAGGTTGC TGTCATATTC AGAAACGAAG ATGGAGAACC TCCTTTTGAA
1561 AGGGACTTGC TCATTCATTG TAAACCAGAT CCCAATAATC CAAATGCCAC TAAAATGAAA
1621 CAAATCAGTA TCCTGTTTCC TACATTAGAT GCAATGACAT ATCCTATTCT TTTTCCACAT
1681 GGTGAAAAAG CTGGGGAAC AGATATTGCA TTAAGACTCA GAGACAACAG TGTAATCGAC
1741 AATAATACTA GACAAAATGT AAGGACACGA GTCACACAAA TGCAGTATTA TGGATTTCAT
1601 CTCTCTGTGC GGGACACGTT GAATCCTATT TTAAATGCAG GAAAATTAAC TCAACAGTTT
1861 ATTGTGGATT CATATTCAAA AATCGAGGCC AATCGGATAA ATTTCATCAA AGCAAACCAA
1921 TCTAAGTTGA GAGTTGAAAA ATATAGTGGT TTGATGGATT ATCTCAAATC TAGATCTGAA
1981 AATGACAATG TGCCGATTGG TAAAATGATA ATACTTCCAT CATCTTTTGA GGGTAGTCCC
2041 AGAAATATGC AGCAGCGATA TCAGGATGCT ATGGCAATTG TAACGAAGTA TGGCAAGCCC
2101 GATTATTCA TAACCATGAC ATGCAACCCC AAATGGGCAG ATATTACAAA CAATTTACAA
2161 CGCTGGCAAA AAGTTGAAAA CAGACCTGAC TTGGTAGCCA GAGTTTTTAA TATTAAGCTG
2221 AATGCTCTTT TAAATGATAT ATGTAAATTC CATTTATTTG GGAAAGTAAT AGCTAAAATT
2281 CATGTCATTG AATTTCAGAA ACGCGGACTG CCTCACGCTC ACATATTATT GATATTAGAT
2341 AGTGAGTCCA AATTACGTTC AGAAGATGAC ATTGACCGTA TAGTTAAGGC AGAAATTCCA
2401 GATGAAGACC AGTGTCCTCG ACTTTTTCAA ATTGTAAAAT CAAATATGGT ACATGGACCA
2461 TGTGGAATAC AAAATCGAAA TAGTCCATGT ATGGAAAATG GAAATGTTC AAAGGGATAT
2521 CCAAAAGAAT TTCAAAATGC GACCA1TGGA AATATTGATG GATATCCGAA ATACAAACGA
2581 AGATCTGGTA GCACCATGTC TATTGGAAAT AAAGTTGTCG ATAACACTTG GATTGTCCCT
```

-continued

```
2641 TATAACCCGT ATTTGTGCCT TAAATATAAC TGTCATATAA ATGTTGAAGT CTGTGCATCA

2701 ATTAAAAGTG TCAAATATTT ATTTAAATAC ATCTATAAAG GGCACGATTG TGCAAATATT

2761 CAAATTTCTG AAAAAAATAT TATCAATCAT GACGAAGTAC AGGACTTCAT TGACTCCAGG

2821 TATGTGAGCG CTCCTGAGGC TGTTTGGAGA CTTTTTGCAA TGCGAATGCA TGACCAATCT

2881 CATGCAATCA CAAGATTAGC TATTCATTTG CCAAATGATC AGAATTTGTA TTTTCATACC

2941 GATGATTTTG CTGAAGTTTT AGATAGGGCT AAAAGGCATA ACTCGACTTT GATGGCTTGG

3001 TTCTTATTGA ATAGAGAAGA TTCTGATGCA CGTAATTATT ATTATTGGGA GATTCCACAG

3061 CATTATGTCT TTAATAATTC TTTGTGGACA AAACGCCGAA AGGGTGGGAA TAAAGTATTA

3121 GGTAGACTGT TCACTGTGAG CTTTAGAGAA CCAGAACGAT ATTAGCTTAG ACTTTTGCTT

3181 CTGCATGTAA AAGGTGCGAT AAGTTTTGAG GATCTGCGAA CTGTAGGAGG TGTAACTTAT

3241 GATACATTTC ATGAAGCTGC TAAACACCGA GGATTATTAC TTGATGACAC TATCTGGAAA

3301 GATACGATTG ACGATGCAAT CATCCTTAAT ATGCCCAAAC AACTACGGCA ACTTTTTGCA

3361 TATATATGTG TGTTTGGATG TCCTTCTGCT GCAGACAAAT TATGGGATGA GAATAAATCT

3421 CATTTTATTG TTGATTTCTG TTGGAAATTA CACCGAAGAG AAGGTGCCTG TGTGAACTGT

3481 GAAATGCATG CCCTTAACGA AATTCAGGAG GTATTCACAT TGCATGGAAT GAAATGTTCA

3541 CATTTCAAAC TTCCGGACTA TCCTTTATTA ATGAATGCAA ATACATGTGA TCAATTGTAC

3601 GAGCAACAAC AGGCAGAGGT TTTGATAAAT TCTCTGAATG ATGAACAGTT GGCAGCCTTT

3661 CAGACTATAA CTTCAGCCAT CGAAGATCAA ACTGTACACC CCAAATGCTT TTTCTTGGAT

3721 GGTCCAGGTG GTAGTGGAAA AACATATCTG TATAAAGTTT TAACACATTA TATTAGAGGT

3781 CGTGGTGGTA CTGTTTTACC CACAGCATCT ACAGGAATTG CTGCAAATTT ACTTCTTGGT

3841 GGAAGAACCT TTGATTCCCA ATATAAATTA CCAATTCCAT TAAATGAAAC TTCAATTTCT

3901 AGACTCGATA TAAAGAGTGA AGTTGCTAAA ACCATTAAAA AGGCCCAACT TCTCATTATT

3961 GATGAATGCA CCATGGCATC CAGTCATGCT ATAAACGCCA TAGATAGATT ACTAAGAGAA

4021 ATTATGAATT TGAATGTTGC ATTTGGTGGG AAAGTTCTCC TTCTCGGAGG GGATTTTCGA

4081 CAATGTCTCA GTATTGTACC ACATGCTATG CGATCGGCCA TAGTACAAAC GAGTTTAAAG

4141 TACTGTAATG TTTGGGGATG TTTCAGAAAG TTGTCTCTTA AAACAAATAT GAGATCAGAG

4201 GATTCTGCTT ATAGTGAATG GTTAGTAAAA CTTGGAGATG GCAAACTTGA TAGCAGTTTT

4261 CATTTAGGAA TGGATATTAT TGAAATCCCC CATGAAATGA TTTGTAACCC ATCTATTATT

4321 GAAGCTACCT TTGAAAATAG TATATCTATA GATAATATTA AAAATATATC TAAACGTGCA

4381 ATTCTTTGTC CAAAAAATGA GCATGTTCAA AAATTAAATG AAGAAATTTT GGATATACTT

4441 GATGGAGATT TTCACACATA TTTGAGTGAT GATTCCATTG ATTCAACAGA TGATGCTGAA

4501 AAGGAAAATT TTCCCATCGA ATTTCTTAAT AGTATTACTC CTTCGGGAAT GCCGTGTCAT

4561 AAATTAAAAT TGAAAGTGGG TGCAATCATC ATGCTATTGA GAAATCTTAA TAGTAAATGG

4621 GGTCTTTGTA ATGGTACTAG ATTTATTATC AAAAGATTAC GACCTAACAT TATCGAAGCT

4681 GAAGTATTAA CAGGATCTGC AGAGGGAGAG GTTGTTCTGA TTCCAAGAAT TGATTTGTCC

4741 CCATCTGACA CTGGCCTCCC ATTTAAATTA ATTCGAAGAC AGTTTCCCGT GATGCCAGCA

4801 TTTGCGATGA CTATTAATAA ATCACAAGGA CAAACTCTAG ACAGAGTAGG AATATTCCTA

4861 CCTGAACCCG TTTTCGCACA TGGTCAGTTA TATGTTGCTT TCTCTCGAGT TCGAAGAGCA

4921 TGTGACGTTA AAGTTAAAGT TGTAAATACT TCATCACAAG GGAAATTAGT CAAGCACTCT

4981 GAAAGTGTTT TTACTCTTAA TGTGGTATAC AGGGAGATAT TAGAATAAGT TTAATCACTT
```

```
-continued
5041 TATCAGTCAT TGTTTGCATC AATGTTGTTT TTATATCATG TTTTTGTTGT TTTTATATCA

5101 TGTCTTTGTT GTTGTTATAT CATGTTGTTA TTGTTTATTT ATTAATAAAT TTATGTATTA

5161 TTTTCATATA CATTTTACTC ATTTCCTTTC ATCTCTCACA CTTCTATTAT AGAGAAAGGG

5221 CAAATAGCAA TATTAAAATA TTTCCTCTAA TTAATTCCCT TTCAATGTGC ACGAATTTCG

5281 TGCACCGGGC CACTAG.
```

Unlike other transposases the Helitron transposase does not contain an RNase-H like catalytic domain, but instead comprises a RepHel motif made up of a replication initiator domain (Rep) and a DNA helicase domain. The Rep domain is a nuclease domain of the HUH superfamily of nucleases.

An exemplary Helitron transposase of the disclosure comprises an amino acid sequence comprising:

```
                                    (SEQ ID NO: 14501)
   1 MSKEQLLXQR SSAAERCRRY RQKMSAEQRA

SDLERRRRLQ QKVSEEQLLE KRRSEAEKQR

61 RHRQKMSKDQ RAFEVERRRW RRQNMSREQS

STSTTNTGRN CLLSKNGVHE DAILEHSCGG

121 MTVRCEFCLS LNFSDEKPSD GKFTRCCSKG

KVCPNDIHFP DYPAYLKRLM TNEDSDSKNF

181 MENIRSINSS FAFASMGANI ASPSGYGPYC

FRIHGQVYHR TGTLHPSDGV SRKFAQLYIL

241 DTAEATSKRL AMPENQGCSE RLMININNLM

HEINELTKSY KMLHEVEKEA QSEAAAKGIA

301 PTEVTMAIKY DRNSDPGRYN SPRVTEVAVI

FRNEDGEPPF ERDLLIHCKP DPNNPNATKM

361 KQISILFPTL DAMTYPILFP HGEKGWGTDI

ALRLRDNSVI DKNTRQMVRT RVTQMQYYGF

421 HLSVRDTFNP ILNAGKLTQQ FIVDSYSKME

ANRINFIKAN QSKLRVEKYS GLMDYLKSRS

481 ENDNVPIGKM IILPSSFEGS PRNMQQRYQD

AMAIVTKYSK PDLFITMTCN PKWADITNNL

541 QRWQKVENRP DLVARVFNIK LNALLNDICK

FHLFGKVIAK IHVIEFQKRG LPHAHILLIL

601 DSESKLR8ED DIDRIYKAEI PDEDQCPRLF

QIVKSMMVHG PCGIQNPNSP CMENGKCSKG

661 YPKEFQNATI GNIDGYPKYK RRSGSTMSIG

NKVVDNTWIV PYNPYLCLKY NCHINVEVCA

721 SIKSVKYLFK YIYKGHDCAN IQISEKNIIN

HDEVQDFIDS RYVSAPEAVW RLFAMRMHDQ

781 SHAITRLAIH LPMDQMLYFH TDDFAEVLDR

AKRHNSTLMA WFLLNREDSD ARNYYYWEIP
```

```
               -continued
 841 QHYVFNNSLW TKRRKGGMKV LGRLFTVSFR

EPERYYLRLL LLHVKGAISF EDLRTVGGVT

901 YDTFHEAAKH RGLLLDDTIW KDTIDDAIIL

NMPKQLRQLF AYICVFGCPS AADKLWDENK

561 SHFIEDFCWK LHRREGACVN CEMHALNEIQ

EVFTLHGMKC SHFKLPDYPL LMNANTCDQL

1021 YEQQQAEVLI NSLMDEQLAA FQTITSAIED

QTVHPKCFFL DGPGGSGKTY LYKVLTHYIR

1081 GRGGTVLPTA STGIAANLLL GGRTFHSQYK

LPIPLNETSI SRLDIKSEVA KTIKKAQLLI

1141 IDECTMASSH AINAIDRLLR EXMNLNVAFG

GKVLLLGGDF RQCLSIVPHA MRSAIVQTSL

1201 KYCNVWGCFR KLSLKTNMRS EDSAYSEWLV

KLGDGKLDSS FHLGMDIIEI PHEMICNGSI

1261 IEATFGNSIS IDNIKNISKR AILCPKNEHV

QKLNEEILDI LDGDFHTYLS DDSIDSTDDA

1321 EKENFPIEFL NSITPSGMPC HKLKLKVGAI

IMLLRNLNSK WGLCNGTRET IKRLRPNIIE

1381 AEVLTGSAEG EVVLIPRIDL SPSDTGLPFK

LIRRQFPVMP AFAMTIMKSQ GQTLDRVGIF

1441 LPEPVFAHGQ LYVAFSRVRR ACDVKVKVVN

TSSQGKLVKH SESVFTLNVV YREILE.
```

In Helitron transpositions, a hairpin close to the 3' end of the transposon functions as a terminator. However, this hairpin can be bypassed by the transposase, resulting in the transduction of flanking sequences. In addition, Helraiser transposition generates covalently closed circular intermediates. Furthermore, Helitron transpositions can lack target site duplications. In the Helraiser sequence, the transposase is flanked by left and right terminal sequences termed LTS and RTS. These sequences terminate with a conserved 5'-TC/CTAG-3' motif. A 19 bp palindromic sequence with the potential to form the hairpin termination structure is located 11 nucleotides upstream of the RTS and consists of the sequence

```
                                    (SEQ ID NO: 14500)
GTGCACGAATTTCGTGCACCGGGCCACTAG.
```

Tol2 transposons may be isolated or derived from the genome of the medaka fish, and may be similar to transposons of the hAT family. Exemplary Tol2 transposons of the disclosure are encoded by a sequence comprising about 4.7 kilobases and contain a gene encoding the Tol2 transposase, which contains four exons. An exemplary Tol2 transposase of the disclosure comprises an amino acid sequence comprising the following:

(SEQ ID NO: 14502)

```
  1  MEEVCDSSAA ASSTVQNQPQ DQEHPWPYLR EFFSLSGVNK DSFKMKCVLC LDLNKEISAF
 61  KSSPSNLRKH IERMHPNYLK NYSKLTAQKR KIGTSTHASS SKQLKVDSVF PVKHVSPVTV
121  NKAILRYIIQ GLHPFSTVDL PSFKELISTL QPGISVITRP TLRSKIAEAA LIMKQKVTAA
181  MSEVEWIATT TDCWTARRKS FIGVTAHWIN PGSLERHSAA LACKRLMGSH TFEVLASAMN
241  DIHSEYEIRD KVVCTTTDSG SNFMKAFRVF GVENNDIETE ARRCESDDTD SEGCGEGSDG
301  VEFQDASRVL DQDDGFEFQL PKHQKCACHL LNLVSSVDAQ KALSNEHYKK LYRSVFGKCQ
361  ALWNKSSRSA LAAEAVSESES RLQLLRPNQT RWNSTFMAVD RILQICKEAG EGALRNICTS
421  LEVPMFNPAE MLFLTEWANT MRPVAKVLDI LQAETNTQLG WLLPSVHQLS LKLQRLHHSL
481  RYCDPLVDAL QQGIQTRFKH MFEDPEIIAA AILLPKFRTS WTNDETIIKR GMDYIRVHLE
541  PLDHKKELAN SSSDDEDFFA SLKPTTHEAS KELDGYLACV SDTRESLLTF PAICSLSIKT
601  NTPLTASAAC ERLFSTAGLL FSPKRARLDT NNFENQLLLK LNLREYNFE
```

An exemplary Tol2 transposon of the disclosure, including inverted repeats, subterminal sequences and the Tol2 transposase, is encoded by a nucleic acid sequence comprising the following:

(SEQ ID NO: 17041)

```
   1  CAGAGGTGTA AAGTACTTGA GTAATTTTAC TTGATTACTG TACTTAAGTA TTATTTTTGG
  61  GGATTTTTAC TTTACTTGAG TACAATTAAA AATCAATACT TTTACTTTTA CTTAATTACA
 121  TTTTTTTAGA AAAAAAGTA CTTTTTACTC CTTACAATTT TATTTACAGT CAAAAAGTAC
 181  TTATTTTTTG GAGATCACTT CATTCTATTT TCCCTTGCTA TTACCAAACC AATTGAATTG
 241  CGCTGATGCC CAGTTTAATT TAAATGTTAT TTATTCTGCC TATGAAAATC GTTTTCACAT
 301  TATATGAAAT TGGTCAGACA TGTTCATTGG TCCTTTGGAA GTGACGTCAT GTCACATCTA
 361  TTACCACAAT GCACAGCACC TTGACCTGGA AATTAGGGAA ATTATAACAG TCAATCAGTG
 421  GAAGAAAATG GAGGAAGTAT GTGATTCATC AGCAGCTGCG AGCAGCACAG TCCAAAATCA
 481  GCCACAGGAT CAAGAGCACC CGTGGCCGTA TCTTCGCGAA TTCTTTTCTT TAAGTGGTGT
 541  AAATAAAGAT TCATTCAAGA TGAAATGTGT CCTCTGTCTC CCGCTTAATA AGAAATATC
 601  GGCCTTCAAA AGTTCGCCAT CAAACCTAAG GAAGCATATT GAGGTAAGTA CATTAAGTAT
 661  TTTGTTTTAC TGATAGTTTT TTTTTTTTTT TTTTTTTTTT TTTTGGGTG TGCATGTTTT
 721  GACGTTGATG GCGCGCCTTT TATATGTGTA GTAGGCCTAT TTTCACTAAT GCATGCGATT
 781  GACAATATAA GGCTCACGTA ATAAAATGCT AAAATGCATT TGTAATTGGT AACGTTAGGT
 841  CCACGGGAAA TTTGGCGCCT ATTGCAGCTT TGAATAATCA TTATCATTCC GTGCTCTCAT
 901  TGTGTTTCAA TTCATGCAAA ACACAAGAAA ACCAAGCGAG AAATTTTTTT CCAAACATGT
 961  TGTATTGTCA AAACGGTAAC ACTTTACAAT GAGGTTGATT AGTTCATGTA TTAACTAACA
1021  TTAAATAACC ATGAGCAATA CATTTGTTAC TGTATCTGTT AATCTTTGTT AACGTTAGTT
1081  AATAGAAATA CAGATGTTCA TTGTTTGTTC ATGTTAGTTC ACAGTGCATT AACTAATGTT
1141  AACAAGATAT AAAGTATTAG TAAATGTTGA AATTAACATG TATACGTGCA GTTCATTATT
1201  AGTTCATGTT AACTAATGTA GTTAACTAAC GAACCTTATT GTAAAGTGT TACCATCAAA
1261  ACTAATGTAA TGAAATCAAT TCACCCTGTC ATGTCAGCCT TACAGTCCTG TGTTTTTGTC
1321  AATATAATCA GAAATAAAAT TAATGTTTGA TTGTCACTAA ATGCTACTGT ATTTCTAAAA
```

-continued

```
1381  TCAACAAGTA TTTAACATTA TAAAGTGTGC AATTGGCTGC AAATGTCAGT TTTATTAAAG

1141  GGTTAGTTCA CCCAAAAATG AAAATAATGT CATTAATGAC TCGCCCTCAT GTCGTTCCAA

1501  GCCCGTAAGA CCTCCGTTCA TCTTCAGAAC ACAGTTTAAG ATATTTTAGA TTTAGTCCGA

1561  GAGCTTTCTG TGCCTCCATT GAGAATGTAT GTACGGTATA CTGTCCATGT CCAGAAAGGT

1621  AATAAAAACA TCAAAGTAGT CCATGTGACA TCAGTGGGTT AGTTAGAATT TTTTGAAGCA

1681  TCGAATACAT TTTGGTCCAA AAATAACAAA ACCTACGACT TTATTCGGCA TTGTATTCTC

1741  TTCCGGGTCT GTTGTCAATC CGCGTTCACG ACTTCGCAGT GACGCTACAA TGCTGAATAA

1801  AGTCGTAGGT TTTGTTATTT TTGGACCAAA ATGTATTTTC GATGCTTCAA ATAATTCTAC

1861  CTAACCCACT GATGTCAGAT GGACTACTTT GATGTTTTTA TTACCTTTCT GGACATGGAC

1921  AGTATACCGT ACATACATTT TCAGTGGAGG GACAGAAAGC TCTCGGACTA AATCTAAAAT

1981  ATCTTAAACT GTGTTCCGAA GATGAACGGA GGTGTTACGG GCTTGGAACG ACATGAGGGT

2041  GAGTCATTAA TGACATCTTT TCATTTTTGG GTGAACTAAC CCTTTAATGC TGTAATCAGA

2101  GACTGTATGT GTAATTGTTA CATTTATTCC ATACAATATA AATATTTATT TGTTGTTTTT

2161  ACAGAGAATG CACCCAAATT ACCTCAAAAA CTACTCTAAA TTGACAGCAC AGAAGAGAAA

2221  GATCGGGACC TCCACCCATG CTTCCAGCAG TAAGCAACTG AAAGTTGACT CAGTTTTCCC

2281  AGTCAAACAT GTGTCTCCAG TCACTGTGAA CAAAGCTATA TTAAGGTACA TCATTCAAGG

2341  ACTTCATCCT TTCAGCACTG TTGATCTGCC ATCATTTAAA GAGCTGATTA GTACACTGCA

2401  GCCTGGCATT TCTGTCATTA CAAGGCCTAC TTTACGCTCC AAGATAGCTG AAGCTGCTCT

2461  GATCATGAAA CAGAAAGTGA CTGCTGCCAT GAGTGAAGTT GAATGGATTG CAACCACAAC

2521  GGATTGTTGG ACTGCACGTA GAAAGTCATT CATTGGTGTA ACTGCTCACT GGATCAACCC

2581  TGGAAGTCTT GAAAGACATT CCGCTGCACT TGCCTGCAAA AGATTAATGG CTCTCATAC

2641  TTTTGAGGTA CTGGCCAGTG CCATGAATGA TATCCACTCA GAGTATGAAA TACGTGACAA

2701  GGTTGTTTGC ACAACCACAG ACAGTGGTTC CAACTTTATG AAGGCTTTCA GAGTTTTTGG

2761  TGTGGAAAAC AATGATATCG AGACTGAGGC AAGAAGGTGT GAAAGTGATG ACACTGATTC

2821  TGAAGGCTGT GGTGAGGGAA GTGATGGTGT GGAATTCCAA GATGCCTCAC GAGTCCTGGA

2881  CCAAGACGAT GGCTTCGAAT TCCAGCTACC AAAACATCAA AAGTGTGCCT GTCACTTACT

2941  TAACCTAGTC TCAAGCGTTG ATGCCCAAAA AGCTCTCTCA AATGAACACT ACAAGAAACT

3001  CTACAGATCT GTCTTTGGCA AATGCCAAGC TTTATGGAAT AAAAGCAGCC GATCGGCTCT

3061  AGCAGCTGAA GCTGTTGAAT CAGAAAGCCG GCTTCAGCTT TTAAGGCCAA ACCAAACGCG

3121  GTGGAATTCA ACTTTTATGG CTGTTGACAG AATTCTTCAA ATTTGCAAAG AAGCAGGAGA

3181  AGGCGCACTT CGGAATATAT CCACCTCTCT TGAGGTTCCA ATGTAAGTGT TTTTCCCCTC

3241  TATCGATGTA ACAAATGTG GGTTGTTTTT GTTTAATACT CTTTGATTAT GCTGATTTCT

3301  CCTGTAGGTT TAATCCAGCA GAAATGCTCT TCTTGACACA CTCCGCCAAC ACAATCCGTC

3361  CAGTTGCAAA AGTACTCGAC ATCTTGCAAG CGGAAACGAA TACACAGCTG GGGTGGCTGC

3421  TGCCTAGTGT CCATCAGTTA AGCTTGAAAC TTCAGCGACT CCACCATTCT CTCAGGTACT

3481  GTGACCCACT TGTGGATGCC CTACAACAAG GAATCCAAAC ACGATTCAAG CATATGTTTG

3541  AAGATCCTGA GATCATAGCA GCTGCCATCC TTCTCCCTAA ATTTCGGACC TCTTGGACAA

3601  ATGATGAAAC CATCATAAAA CGAGGTAAAT GAATGCAAGC AACATACACT TGACGAATTG
```

```
3661  TAATCTGGGC AACCTTTGAG CCATACCAAA ATTATTCTTT TATTTATTTA TTTTTGCACT

3721  TTTTAGGAAT GTTATATCCC ATCTTTGGCT GTGATCTCAA TATGAATATT GNFGTAAAGT

3781  ATTCTTGCAG CAGGTTGTAG TTATCCCTCA GTGTTTCTTG AAACCAAACT CATATGTATG

3841  ATATGTGGTT TGGAAATGCA GTTAGATTTT ATGCTAAAAT AAGGGATTTG CATGATTTTA

3901  GATGTAGATG ACTGCACGTA AATGTAGTTA ATGACAAAAT CCATAAAATT TGTTCCCAGT

3961  CAGAAGCCCC TCAACCAAAC TTTTCTTTGT GTCTGCTCAC TGTGCTTGTA GGCATGGACT

4021  ACATCAGAGT GCATCTGGAG CCTTTGGACC ACAAGAAGGA ATTGGCCAAC AGTTCATCTG

4081  ATGATGAAGA TTTTTTCGCT TCTTTGAAAC CGACAACACA TGAAGCCAGC AAAGAGTTGG

4141  ATGGATATCT GGCCTGTGTT TCAGACACCA GGGAGTCTCT GCTCACGTTT CCTGCTATTT

4201  GCAGCCTCTC TATCAAGACT AATACACCTC TTCCCGCATC GGCTGCCTGT GAGAGGCTTT

4261  TCAGCACTGC AGGATTGCTT TTCAGCCCCA AAAGAGCTAG GCTTGACACT AACAATTTTG

4321  AGAATCAGCT TCTACTGAAG TTAAATCTGA GGTTTTACAA CTTTGAGTAG CGTGTACTGG

4381  CATTAGATTG TCTGTCTTAT AGTTTGATAA TTAAATACAA ACAGTTCTAA AGCAGGATAA

4441  AACCTTGTAT GCATTTCATT TAATGTTTTT TGAGATTAAA AGCTTAAACA AGAATCTCTA

4501  GTTTTCTTTC TTGCTTTTAC TTTTACTTCC TTAATACTCA AGTACAATTT TAATGGAGTA

4561  CTTTTTTACT TTTACTCAAG TAAGATTCTA GCCAGATACT TTTACTTTTA ATTGAGTAAA

4621  ATTTTCCCTA AGTACTTGTA CTTTCACTTG AGTAAAATTT TTGAGTACTT TTTACACCTC

4681  TG.
```

Exemplary transposon/transposase systems of the disclosure include, but are not limited to, piggyBac and piggyBac-like transposons and transposases.

PiggyBac and piggyBac-like transposases recognizes transposon-specific inverted terminal repeat sequences (ITRs) on the ends of the transposon, and moves the contents between the ITRs into TTAA or TTAT chromosomal sites. The piggyBac or piggyBac-like transposon system has no payload limit for the genes of interest that can be included between the ITRs.

In certain embodiments, and, in particular, those embodiments wherein the transposon is a piggyBac transposon, the transposase is a piggyBac™, Super piggyBac™ (SPB) transposase. In certain embodiments, and, in particular, those embodiments wherein the transposase is a piggyBac™, Super piggyBac™ (SPB), the sequence encoding the transposase is an mRNA sequence.

In certain embodiments of the methods of the disclosure, the transposase enzyme is a piggyBac or piggyBac-like transposase enzyme.

In certain embodiments of the methods of the disclosure, the transposase enzyme is a piggyBac or a piggyBac-like transposase enzyme. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%. 95%, 99% or any percentage in between identical to:

```
                                                            (SEQ ID NO: 14487)
  1  MGSSLDDEHI LSALLQSDDE LVGEDSDSEI SDHVSEDDVQ SDTEEAFIDE VHEVQPTSSG

61  SEILDEQNVI EQPGSSLASN RILTLPQRTI RGKNKHCWST SKSTRRSRVS ALNIVRSQRG

121  PTRMCRNIYD PLLCFKLFFT DEIISEIVKW TNAEISLKRR ESMTGATFRD TNEDEIYAFF

181  GILVMTAVRK DNHMSTDDLF DRSLSMVYVS VMSRDRFDFL IRCLRMDDKS IRPTLRENDV

241  FTPVRKIWDL FIHQCIQNYT PGAHLTIDEQ LLGFRGRCPF RMYIPNKPSK YGIKILMMCD

301  SGTKYMINGM PYLGRGTQTN GVPLGEYYVK ELSKPVHGSC RNITCDNWFT SIPLALNLLQ

361  EPYKLTIVGT VRSNKREIPE VLKNSRSRPV GTSMFCFDGP LTLVSYKPKP AKMVYLLSSC

421  DEDASINEST GKPQMVMYYN QTKGGVDTLD QMCSVMTCSR KTNRWPMALL YGMINIACIN

481  SFIIYSHNVS SKGEKVQSRK KFMRNLYMSL TSSFMRKRLE APTLKPYLRD NISNILPNEV

541  PGTSDDSTEE PVMKKRTYCT YCPSKIRRKA NASCKKCKKV ICREHNIDMC QSCF.
```

In certain embodiments of the methods of the disclosure, the transposase enzyme is a piggyBac or piggyBac-like transposase enzyme that comprises or consists of an amino acid sequence having an amino acid substitution at one or more of positions 30, 165, 282, or 538 of the sequence:

```
                                                          (SEQ ID NO: 14487)
  1  MGSSLDDEHI  LSALLQSDDE  LVGEDSDSEI  SDHVSEDDVQ  SDTEEAFIDE  VHEVQPTSSG

61  SEILDEQNVI  EQPGSSLASN  RILTLPQRTI  RGKNKHCWST  SKSTRRSRVS  ALNIVRSQRG

121  PTRMCRNIYD  PLLCFKLFFT  DEIISEIVKW  TNAEISLKRR  ESMTGATFRD  TNEDEIYAFF

181  GILVMTAVRK  DNHMSTDDLF  DRSLSMVYVS  VMSRDRFDFL  IRCLRMDDKS  IRPTLRENDV

241  FTPVRKIWDL  FIHQCIQNYT  PGAHLTIDEQ  LLGERGRCPF  RMYIPNKPSK  YGIKILMMCD

301  SGTKYMINGM  PYLGRGTQTN  GVPLGEYYVK  ELSKPVHGSC  RNITCDNWFT  SIPLAKNLLQ

361  EPYKLTIVGT  VRSNKREIPE  VLKNSRSRPV  GTSMFCFDGP  LTLVSYKPKP  AKMVYLLSSC

421  DEDASINEST  GKPQMVNYYN  QTKGGVDTLD  QMCSVMTCSR  KTNRWPMALL  YGMINIACIN

481  SFIIYSHNVS  SKGEKVQSRK  KFMRNLYMSL  TSSFMRKRLE  APTLKRYLRD  NISNILPNEV

541  PGTSDDSTEE  PVMKKRTYCT  YCPSKIRRKA  NASCKKCKKV  ICREHNIDMC  QSCF.
```

In certain embodiments, the transposase enzyme is a piggyBac or piggyBac-like transposase enzyme that comprises or consists of an amino acid sequence having an amino acid substitution at two or more of positions 30, 165, 282, or 538 of the sequence of SEQ ID NO: 14487. In certain embodiments, the transposase enzyme is a piggyBac or piggyBac-like transposase enzyme that comprises or consists of an amino acid sequence having an amino acid substitution at three or more of positions 30, 165, 282, or 538 of the sequence of SEQ ID NO: 14487. In certain embodiments, the transposase enzyme is a piggyBac or piggyBac-like transposase enzyme that comprises or consists of an amino acid sequence having an amino acid substitution at each of the following positions 30, 165, 282, and 538 of the sequence of SEQ ID NO: 14487. In certain embodiments, the amino acid substitution at position 30 of the sequence of SEQ ID NO: 14487 is a substitution of a valine (V) for an isoleucine (I). In certain embodiments, the amino acid substitution at position 165 of the sequence of SEQ ID NO: 14487 is a substitution of a serine (S) for a glycine (G). In certain embodiments, the amino acid substitution at position 282 of the sequence of SEQ ID NO: 14487 is a substitution of a valine (V) for a methionine (M). In certain embodiments, the amino acid substitution at position 538 of the sequence of SEQ ID NO: 14487 is a substitution of a lysine (K) for an asparagine (N).

In certain embodiments of the methods of the disclosure, the transposase enzyme is a Super piggyBac™ (SPB) or piggyBac-like transposase enzyme. In certain embodiments, the Super piggyBac™ (SPB) or piggyBac-like transposase enzyme of the disclosure may comprise or consist of the amino acid sequence of the sequence of SEQ ID NO: 14487 wherein the amino acid substitution at position 30 is a substitution of a valine (V) for an isoleucine (1), the amino acid substitution at position 165 is a substitution of a serine (S) for a glycine (G), the amino acid substitution at position 282 is a substitution of a valine (V) for a methionine (M), and the amino acid substitution at position 538 is a substitution of a lysine (K) for an asparagine (N). In certain embodiments, the Super piggyBac™ (SPB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                                          (SEQ ID NO: 14484)
  1  MGSSLDDEHI  LSALLQSDDE  LVGEDSDSEV  SDHVSEDDVQ  SDTEEAFIDE  VHEVQPTSSG

61  SEILDEQNVI  EQPGSSLASN  RILTLPQRTI  RGKNKHCWST  SKSTRRSRVS  ALNIVRSQRG

121  PTRMCRNIYD  PLLCFKLFFT  DEIISEIVKW  TNAEISLKRR  ESMTSATFRD  TNEDEIYAFF

181  GILVMTAVRK  DNHMSTDDLF  DRSLSMVYVS  VMSRDRFDFL  IRCLRMDDKS  IRPTLRENDV

241  FTPVRKIWDL  FIHQCIQNYT  PGAHLTIDEQ  LLGFRGRCPF  RVYIPNKPSK  YGIKILMMCD

301  SGTKYMINGM  PYLGRGTQTN  GVPLGEYYVK  ELSKPVHGSC  RNITCDNWFT  SIPLAKNLLQ

361  EPYKLTIVGT  VRSNKREIPE  VLKNSRSRPV  GTSMFCFDGP  LTLVSYKPKP  AKMVYLLSSC

421  DEDASINEST  GKPQMVMYYN  QTKGGVDTLD  QMCSVMTCSR  KTNRWPMALL  YGMINIACIN

481  SFIIYSHNVS  SKGEKVQSRK  KFMRNLYMSL  TSSFMRKRLE  APTLKRYLRD  NISNILPKEV

541  PGTSDDSTEE  PVMKKRTYCT  YCPSKIRRKA  NASCKKCKKV  ICREHNIDMC  QSCF.
```

In certain embodiments of the methods of the disclosure, including those embodiments wherein the transposase comprises the above-described mutations at positions 30, 165, 282 and/or 538, the piggyBac™, Super piggyBac™ or piggyBac-like transposase enzyme may further comprise an amino acid substitution at one or more of positions 3, 46, 82, 103, 119, 125, 177, 180, 185, 187, 200, 207, 209, 226, 235, 240, 241, 243, 258, 296, 298, 311, 315, 319, 327, 328, 340, 421, 436, 456, 470, 486, 503, 552, 570 and 591 of the sequence of SEQ ID NO: 14487 or SEQ ID NO: 14484. In certain embodiments, including those embodiments wherein the transposase comprises the above-described mutations at positions 30, 165, 282 and/or 538, the piggyBac™, Super piggyBac™ or piggyBac-like transposase enzyme may further comprise an amino acid substitution at one or more of positions 46, 119, 125, 177, 180, 185, 187, 200, 207, 209, 226, 235, 240, 241, 243, 296, 298, 311, 315, 319, 327, 328, 340, 421, 436, 456, 470, 485, 503, 552 and 570. In certain embodiments, the amino acid substitution at position 3 of SEQ ID NO: 14487 or SEQ ID NO: 14484 is a substitution of an asparagine (N) for a serine (S). In certain embodiments, the amino acid substitution at position 46 of SEQ ID NO: 14487 or SEQ ID NO: 14484 is a substitution of a serine (S) for an alanine (A). In certain embodiments, the amino acid substitution at position 46 of SEQ ID NO: 14487 or SEQ ID NO: 14484 is a substitution of a threonine (T) for an alanine (A). In certain embodiments, the amino acid substitution at position 82 of SEQ ID NO: 14487 or SEQ ID NO: 14484 is a substitution of a tryptophan (W) for an isoleucine (I). In certain embodiments, the amino acid substitution at position 103 of SEQ ID NO: 14487 or SEQ ID NO: 14484 is a substitution of a proline (P) for a serine (S). In certain embodiments, the amino acid substitution at position 119 of SEQ ID NO: 14487 or SEQ ID NO: 14484 is a substitution of a proline (P) for an arginine (R). In certain embodiments, the amino acid substitution at position 125 of SEQ ID NO: 14487 or SEQ ID NO: 14484 is a substitution of an alanine (A) a cysteine (C). In certain embodiments, the amino acid substitution at position 125 of SEQ ID NO: 14487 or SEQ ID NO: 14484 is a substitution of a leucine (L) for a cysteine (C). In certain embodiments, the amino acid substitution at position 177 of SEQ ID NO: 14487 or SEQ ID NO: 14484 is a substitution of a lysine (K) for a tyrosine (Y). In certain embodiments, the amino acid substitution at position 177 of SEQ ID NO: 14487 or SEQ ID NO: 14484 is a substitution of a histidine (H) for a tyrosine (Y). In certain embodiments, the amino acid substitution at position 180 of SEQ ID NO: 14487 or SEQ ID NO: 14484 is a substitution of a leucine (L) for a phenylalanine (F). In certain embodiments, the amino acid substitution at position 180 of SEQ ID NO: 14487 or SEQ ID NO: 14484 is a substitution of an isoleucine (I) for a phenylalanine (F). In certain embodiments, the amino acid substitution at position 180 of SEQ ID NO: 14487 or SEQ ID NO: 14484 is a substitution of a valine (V) for a phenylalanine (F). In certain embodiments, the amino acid substitution at position 185 of SEQ ID NO: 14487 or SEQ ID NO: 14484 is a substitution of a leucine (L) for a methionine (M). In certain embodiments, the amino acid substitution at position 187 of SEQ ID NO: 14487 or SEQ ID NO: 14484 is a substitution of a glycine (G) for an alanine (A). In certain embodiments, the amino acid substitution at position 200 of SEQ ID NO: 14487 or SEQ ID NO: 14484 is a substitution of a tryptophan (W) for a phenylalanine (F) In certain embodiments, the amino acid substitution at position 207 of SEQ ID NO: 14487 or SEQ ID NO: 14484 is a substitution of a proline (P) for a valine (V). In certain embodiments, the amino acid substitution at position 209 of SEQ ID NO: 14487 or SEQ ID NO: 14484 is a substitution of a phenylalanine (F) for a valine (V). In certain embodiments, the amino acid substitution at position 226 of SEQ ID NO: 14487 or SEQ ID NO: 14484 is a substitution of a phenylalanine (F) for a methionine (M). In certain embodiments, the amino acid substitution at position 235 of SEQ ID NO: 14487 or SEQ ID NO: 14484 is a substitution of an arginine (R) for a leucine (L). In certain embodiments, the amino acid substitution at position 240 of SEQ ID NO: 14487 or SEQ ID NO: 14484 is a substitution of a lysine (K) for a valine (V). In certain embodiments, the amino acid substitution at position 241 of SEQ ID NO: 14487 or SEQ ID NO: 14484 is a substitution of a leucine (L) for a phenylalanine (F). In certain embodiments, the amino acid substitution at position 243 of SEQ ID NO: 14487 or SEQ ID NO: 14484 is a substitution of a lysine (K) for a proline (P). In certain embodiments, the amino acid substitution at position 258 of SEQ ID NO: 14487 or SEQ ID NO: 14484 is a substitution of a serine (S) for an asparagine (N). In certain embodiments, the amino acid substitution at position 2% of SEQ ID NO: 14487 or SEQ ID NO: 14484 is a substitution of a tryptophan (W) for a leucine (L). In certain embodiments, the amino acid substitution at position 296 of SEQ ID NO: 14487 or SEQ ID NO: 14484 is a substitution of a tyrosine (Y) for a leucine (L). In certain embodiments, the amino acid substitution at position 296 of SEQ ID NO: 14487 or SEQ ID NO: 14484 is a substitution of a phenylalanine (F) for a leucine (L). In certain embodiments, the amino acid substitution at position 298 of SEQ ID NO: 14487 or SEQ ID NO: 14484 is a substitution of a leucine (L) for a methionine (M). In certain embodiments, the amino acid substitution at position 298 of SEQ ID NO: 14487 or SEQ ID NO: 14484 is a substitution of an alanine (A) for a methionine (M). In certain embodiments, the amino acid substitution at position 298 of SEQ ID NO: 14487 or SEQ ID NO: 14484 is a substitution of a valine (V) for a methionine (M). In certain embodiments, the amino acid substitution at position 311 of SEQ ID NO: 14487 or SEQ ID NO: 14484 is a substitution of an isoleucine (I) for a proline (P). In certain embodiments, the amino acid substitution at position 311 of SEQ ID NO: 14487 or SEQ ID NO: 14484 is a substitution of a valine for a proline (P). In certain embodiments, the amino acid substitution at position 315 of SEQ ID NO: 14487 or SEQ ID NO: 14484 is a substitution of a lysine (K) for an arginine (R). In certain embodiments, the amino acid substitution at position 319 of SEQ ID NO: 14487 or SEQ ID NO: 14484 is a substitution of a glycine (G) for a threonine (T). In certain embodiments, the amino acid substitution at position 327 of SEQ ID NO: 14487 or SEQ ID NO: 14484 is a substitution of an arginine (R) for a tyrosine (Y). In certain embodiments, the amino acid substitution at position 328 of SEQ ID NO: 14487 or SEQ ID NO: 14484 is a substitution of a valine (V) for a tyrosine (Y). In certain embodiments, the amino acid substitution at position 340 of SEQ ID NO: 14487 or SEQ ID NO: 14484 is a substitution of a glycine (G) for a cysteine (C). In certain embodiments, the amino acid substitution at position 340 of SEQ ID NO: 14487 or SEQ ID NO: 14484 is a substitution of a leucine (L) for a cysteine (C). In certain embodiments, the amino acid substitution at position 421 of SEQ ID NO: 14487 or SEQ ID NO: 14484 is a substitution of a histidine (H) for the aspartic acid (D). In certain embodiments, the amino acid substitution at position 436 of SEQ ID NO: 14487 or SEQ ID NO: 14484 is a substitution of an isoleucine (I) for a valine (V). In certain embodiments, the amino acid substitution at position 456 of SEQ ID NO: 14487 or SEQ ID NO: 14484 is a substitution of a tyrosine (Y) for a methionine (M). In certain embodiments, the amino acid substitution at position 470 of SEQ ID NO: 14487 or SEQ ID NO: 14484 is a substitution of a phenylalanine (F) for a leucine (L). In certain embodiments, the amino acid substitution at position 485 of SEQ ID NO: 14487 or SEQ ID NO: 14484 is a substitution of a lysine (K) for a serine (S). In certain embodiments, the amino acid substitution at position 503 of SEQ ID NO: 14487 or SEQ ID NO: 14484 is a substitution of a leucine (L) for a methionine (M). In certain embodiments, the amino acid substitution at position 503 of SEQ ID NO: 14487 or SEQ ID NO: 14484 is a substitution of an isoleucine (I) for a methionine (M). In certain embodiments, the amino acid substitution at position 552 of SEQ ID NO: 14487 or SEQ ID NO: 14484 is a substitution of a lysine (K) for a valine (V). In certain embodiments, the amino acid substitution at position 570 of SEQ ID NO: 14487 or SEQ ID NO: 14484 is a substitution of a threonine (T) for an alanine (A). In certain embodiments, the amino acid substitution at position 591 of SEQ ID NO: 14487 or SEQ ID NO: 14484 is a substitution of a proline (P) for a glutamine (Q). In certain embodiments, the amino acid substitution at position 591 of SEQ ID NO: 14487 or SEQ ID NO: 14484 is a substitution of an arginine (R) for a glutamine (Q).

In certain embodiments of the methods of the disclosure, including those embodiments wherein the transposase comprises the above-described mutations at positions 30, 165, 282 and/or 538, the piggyBac™ or piggyBac-like transposase enzyme or may comprise or the Super piggyBac™ transposase enzyme may further comprise an amino acid substitution at one or more of positions 103, 194, 372, 375, 450, 509 and 570 of the sequence of SEQ ID NO: 14487 or SEQ ID NO: 14484. In certain embodiments of the methods of the disclosure, including those embodiments wherein the transposase comprises the above-described mutations at positions 30, 165, 282 and/or 538, the piggyBac™ or piggyBac-like transposase enzyme may comprise or the Super piggyBac™ transposase enzyme may further comprise an amino acid substitution at two, three, four, five, six or more of positions 103, 194, 372, 375, 450, 509 and 570 of the sequence of SEQ ID NO: 14487 or SEQ ID NO: 14484. In certain embodiments, including those embodiments wherein the transposase comprises the above-described mutations at positions 30, 165, 282 and/or 538, the piggyBac™ or piggyBac-like transposase enzyme may comprise or the Super piggyBac™ transposase enzyme may further comprise an amino acid substitution at positions 103, 194, 372, 375, 450, 509 and 570 of the sequence of SEQ ID NO: 14487 or SEQ ID NO: 14484. In certain embodiments, the amino acid substitution at position 103 of SEQ ID NO: 14487 or SEQ ID NO: 14484 is a substitution of a proline (P) for a serine (S). In certain embodiments, the amino acid substitution at position 194 of SEQ ID NO: 14487 or SEQ ID NO: 14484 is a substitution of a valine (V) for a methionine (M). In certain embodiments, the amino acid substitution at position 372 of SEQ ID NO: 14487 or SEQ ID NO: 14484 is a substitution of an alanine (A) for an arginine (R). In certain embodiments, the amino acid substitution at position 375 of SEQ ID NO: 14487 or SEQ ID NO: 14484 is a substitution of an alanine (A) for a lysine (K) In certain embodiments, the amino acid substitution at position 450 of SEQ ID NO: 14487 or SEQ ID NO: 14484 is a substitution of an asparagine (N) for an aspartic acid (D). In certain embodiments, the amino acid substitution at position 509 of SEQ ID NO: 14487 or SEQ ID NO: 14484 is a substitution of a glycine (G) for a serine (S). In certain embodiments, the amino acid substitution at position 570 of SEQ ID NO: 14487 or SEQ ID NO: 14484 is a substitution of a serine (S) for an asparagine (N). In certain embodiments, the piggyBac™ or piggyBac-like transposase enzyme may comprise a substitution of a valine (V) for a methionine (M) at position 194 of SEQ ID NO: 14487. In certain embodiments, including those embodiments wherein the piggyBac™ or piggyBac-like transposase enzyme may comprise a substitution of a valine (V) for a methionine (M) at position 194 of SEQ ID NO: 14487, the piggyBac™ or piggyBac-like transposase enzyme may further comprise an amino acid substitution at positions 372, 375 and 450 of the sequence of SEQ ID NO: 14487 or SEQ ID NO: 14484. In certain embodiments, the piggyBac™ or piggyBac-like transposase enzyme may comprise a substitution of a valine (V) for a methionine (M) at position 194 of SEQ ID NO: 14487, a substitution of an alanine (A) for an arginine (R) at position 372 of SEQ ID NO: 14487, and a substitution of an alanine (A) for a lysine (K) at position 375 of SEQ ID NO: 14487. In certain embodiments, the piggyBac™ or piggyBac-like transposase enzyme may comprise a substitution of a valine (V) for a methionine (M) at position 194 of SEQ ID NO: 14487, a substitution of an alanine (A) for an arginine (R) at position 372 of SEQ ID NO: 14487, a substitution of an alanine (A) for a lysine (K) at position 375 of SEQ ID NO: 14487 and a substitution of an asparagine (N) for an aspartic acid (D) at position 450 of SEQ ID NO: 14487.

In certain embodiments, the piggyBac or piggyBac-like transposase enzyme is isolated or derived from an insect. In certain embodiments, the insect is *Trichoplusia ni* (GenBank Accession No. AAA87375; SEQ ID NO: 17083). *Argyrogramma agnata* (GenBank Accession No. GU477713; SEQ ID NO: 17084, SEQ ID NO: 17085), *Anopheles gambiae* (GenBank Accession No. XP_312615 (SEQ ID NO: 17086); GenBank Accession No. XP_320414 (SEQ ID NO: 17087); GenBank Accession No. XP_310729 (SEQ ID NO: 17088)), *Aphis gossypii* (GenBank Accession No. GU329918; SEQ ID NO: 17089, SEQ ID NO: 17090), *Acyrthosiphon pisum* (GenBank Accession No. XP_001948139; SEQ ID NO: 17091), *Agrotis ipsilon* (GenBank Accession No. GU477714; SEQ ID NO: 17092, SEQ ID NO: 17093). *Bombyx mori* (GenBank Accession No. BAD11135; SEQ ID NO: 17094). *Chilo suppressalis* (GenBank Accession No. JX294476; SEQ ID NO: 17095, SEQ ID NO: 17096). *Drosophila melanogaster* (GenBank Accession No. AAL39784; SEQ ID NO: 17097), *Helicoverpa armigera* (GenBank Accession No. ABS18391; SEQ ID NO: 17098). *Heliothis virescens* (GenBank Accession No. ABD76335; SEQ ID NO: 17099) Macdunnoughia crassisigna (GenBank Accession No. EU287451; SEQ ID NO: 17100, SEQ ID NO: 17101). *Pectinophora gossypiella* (GenBank Accession No. GU270322; SEQ ID NO: 17102, SEQ ID NO: 17103), *Tribolium castaneum* (GenBank Accession No. XP_001814566; SEQ ID NO: 17104), *Ctenoplusia agnata* (also called *Argyrogramma agnata*), *Messour bouvieri, Megachile rotundata, Bombus impatiens, Mamestra brassicae, Mayetiola destructor* or *Apis mellifera*.

In certain embodiments, the piggyBac or piggyBac-like transposase enzyme is isolated or derived from an insect. In certain embodiments, the insect is *Trichoplusia ni* (AAA87375).

In certain embodiments, the piggyBac or piggyBac-like transposase enzyme is isolated or derived from an insect. In certain embodiments, the insect is *Bombyx mori* (BAD11135).

In certain embodiments, the piggyBac or piggyBac-like transposase enzyme is isolated or derived from a crustacean. In certain embodiments, the crustacean is *Daphnia pulicaria* (AAM76342, SEQ ID NO: 17105).

In certain embodiments, the piggyBac or piggyBac-like transposase enzyme is isolated or derived from a vertebrate. In certain embodiments, the vertebrate is *Xenopus tropicalis* (GenBank Accession No. BAF82026; SEQ ID NO: 17106), *Homo sapiens* (GenBank Accession No. NP_689808; SEQ ID NO: 17107), *Mus musculus* (GenBank Accession No. NP_741958; SEQ ID NO: 17108). *Macaca fascicularis* (GenBank Accession No. AB179012; SEQ ID NO: 17108, SEQ ID NO: 17109), *Rattus norvegicus* (GenBank Accession No. XP_220453; SEQ ID NO: 17110) or *Myotis lucifugus*.

In certain embodiments, the piggyBac or piggyBac-like transposase enzyme is isolated or derived from a urochordate. In certain embodiments, the urochordate is *Ciona intestinalis* (GenBank Accession No. XP_002123602; SEQ ID NO: 17111).

In certain embodiments, the piggyBac or piggyBac-like transposase inserts a transposon at the sequence 5'-TTAT-3' within a chromosomal site (a TTAT target sequence).

In certain embodiments, the piggyBac or piggyBac-like transposase inserts a transposon at the sequence 5'-TTAA-3' within a chromosomal site (a TTAA target sequence).

In certain embodiments, the target sequence of the piggyBac or piggyBac-like transposon comprises or consists of 5'-CTAA-3', 5'-TTAG-3', 5'-ATAA-3', 5'-TCAA-3', 5'AGTT-3', 5'-ATTA-3', 5'-GTTA-3', 5'-TTGA-3', 5'-TTTA-3', 5'-TTAC-3', 5'-ACTA-3', 5'-AGGG-3', 5'-CTAG-3', 5'-TGAA-3', 5'-AGGT-3', 5'-ATCA-3', 5'-CTCC-3', 5'-TAAA-3', 5'-TCTC-3', 5'TGAA-3', 5'-AAAT-3', 5'-AATC-3', 5'-ACAA-3', 5'-ACAT-3', 5'-ACTC-3', 5'-AGTG-3', 5-ATAG-3', 5-CAAA-3', 5'-CACA-3', 5'-CATA-3', 5-CCAG-3', 5'-CCCA-3', 5'-CGTA-3', 5'-GTCC-3', 5'-TAAG-3', 5'-TCTA-3', 5'-TGAG-3', 5'-TGTT-3', 5'-TTCA-3'5'-TTCT-3' and 5'-TTTT-3'.

In certain embodiments of the methods of the disclosure, the transposase enzyme is a piggyBac or piggyBac-like transposase enzyme. In certain embodiments, the piggyBac or piggyBac-like transposase enzyme is isolated or derived from *Bombyx mori*. The piggyBac or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                                      (SEQ ID NO: 14504)
  1    MDIERQEERI RAMLEEELSD YSDESSSEDE TDHCSEHEVN YDTEEERIDS VDVPSNSRQE

61    EANAIIANES DSDPDDDLPL SLVRQRASAS RQVSGPFYTS KDGTKWYKNC QRPNVRLRSE

121    NIVTEQAQVK NIARDASTEY ECWNIFVTSD MLQEILTHTN SSIRHRQTKT AAENSSAETS

181    FYMQETTLCE LKALIALLYL AGLIKSNRQS LKDLWRTDGT GVDIFRTTMS LQRFQFLQNN

241    IRFDDKSTRD ERKQTDNMAA FRSIFDQFVQ CCQNAYSPSE FLTIDEMLLS FRGRCLFRVY

301    IPNKPAKYGI KILALVDAKN FDVVNLEVYA GKQPSGPYAV SNRPFEVVER LIQPVARSHR

361    NVTFDNWFTG YELMLHLLNE YRLTSVGTVR KNKRQIPESF IRTDRQPNSS VFGFQKDITL

421    VSYAPKKNKV VVVMSTMHHD NSIDESTGEK QKPEMITFYN STKAGVDVVD ELSANYNVSR

481    NSKRWPMTLF YGVLNMAAIN ACIIYRANKN VTIKRTEFIR SLGLSMIYEH LHSRNKKKNI

541    PTYLRQRIEK QLGEPSPRHV NVPGRYVRCQ DCPYKKDRKT KHSCNACAKP ICMEHAKFLC

601    ENCAELDSSL.
```

The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90°%, 95%, 99% or any percentage in between identical to:

```
                                                      (SEQ ID NO: 14505)
  1    MDIERQEERI RAMLEEELSD YSDESSSEDE TDHCSEHEVN YDTEEERIDS VDVPSNSRQE

61    EANAIIANES DSDPDDDLPL SLVRQRASAS RQVSGPFYTS KDGTKWYKNC QRPNVRLRSE

121    NIVTEQAQVK NIARDASTEY ECWNIFVTSD MLQEILTHTN SSIRHRQTKT AAENSSAETS

181    FYMQETTLCE LKALIALLYL AGLIKSNRQS LKDLWRTDGT GVDIFRTTMS LQRFQFLQNN

241    IRFDDKSTRD ERKQTDNMAA FRSIFDQFVQ CCQNAYSPSE FLTIDEMLLS FRGRCLFRVY

301    IPNKPAKYGI KILALVDAKN FYVVNLEVYA GKQPSGPYAV SNRPFEVVER LIQPVARSHR

361    NVTFDNWFTG YELMLHLLNE YRLTSVGTVR KNKRQIPESF IRTDRQPNSS VFGFQKDITL

421    VSYAPKKNKV VVVMSTMHHD NSIDESTGEK QKPEMITFYN STKAGVDVVD ELCANYNVSR

481    NSKRWPMTLF YGVLNMAAIN ACIIYRTNKN VTIKRTEFIR SLGLSMIYEH LHSRNKKKNI

541    PTYLRQRIEK QLGEPSPRHV NVPGRYVRCQ DCPYKKDRKT KRSCNACAKP ICMEHAKFLC

601    ENCAELDSSL.
```

In certain embodiments, the piggyBac or piggyBac-like transposase is fused to a nuclear localization signal. In certain embodiments, the amino acid sequence of the piggyBac or piggyBac-like transposase fused to a nuclear localization signal is encoded by a polynucleotide sequence comprising.

(SEQ ID NO: 14629)

```
   1 atggcaccca aaaagaaacg taaagtgatg gacattgaaa gacaggaaga aagaatcagg
  61 gcgatgctcg aagaagaact gagcgactac tccgacgaat cgtcatcaga ggatgaaacc
 121 gaccactgta gcgagcatga ggttaactac gacaccgagg aggagagaat cgactctgtg
 181 gatgtgccct ccaactcacg ccaagaagag gccaatgcaa ttatcgcaaa cgaatcggac
 241 agcgatccag acgatgatct gccactgtcc ctcgtgcgcc agcgggccag cgcttcgaga
 301 caagtgtcag gtccattcta cacttcgaag gacggcacta agtggtacaa gaattgccag
 361 cgacctaacg tcagactccg ctccgagaat atcgtgaccg aacaggctca ggtcaagaat
 421 atcgcccgcg acgcctcgac tgagtacgag tgttggaata tcttcgtgac ttcggacatg
 481 ctgcaagaaa ttctgacgca caccaacagc tcgattaggc atcgccagac caagactgca
 541 gcggagaact catcggccga aacctccttc tatatgcaag agactactct gtgcgaactg
 601 aaggcgctga ttgcactgct gtacttggcc ggcctcatca aatcaaatag gcagagcctc
 661 aaagatctct ggagaacgga tggaactgga gtggatatct tcggacgac tatgagcttg
 721 cagcggttcc agtttctgca aaacaatatc agattcgacg acaagtccac ccgggacgaa
 781 aggaaacaga ctgacaacat ggctgcgttc cggtcaatat tcgatcagtt tgtgcagtgc
 841 tgccaaaacg cttatagccc atcggaattc ctgaccatcg acgaaatgct tctctccttc
 901 cgggggcgct gcctgttccg agtgtacatc ccgaacaagc cggctaaata cggaatcaaa
 961 atcctggccc tggtggacgc caagaatttc tacgtcgtga atctcgaagt gtacgcagga
1021 aagcaaccgt cgggaccgta cgctgtttcg aaccgcccgt ttgaagtcgt cgagcggctt
1081 attcagccgg tggccagatc ccaccgcaat gttaccttcg acaattggtt caccggctac
1141 gagctgatgc ttcaccttat gaacgagtac ggctcacta gcgtggggac tgtcaggaag
1201 aacaagcggc agatcccaga atccttcatc cgcaccgacc gccagcctaa ctcgtccgtg
1261 ttcggatttc aaaaggatat cacgcttgtc tcgtacgccc ccaagaaaaa caaggtcgtg
1321 gtcgtgatga gcaccatgca tcacgacaac agcatcgacg agtcaaccgg agaaaagcaa
1381 aagcccgaga tgatcaccct ctacaattca actaaggccg gcgtcgacgt cgtggatgaa
1441 ctgtgcgcga actataacgt gtcccggaac tctaagcggt ggcctatgac tctcttctac
1501 ggagtgctga atatggccgc aatcaacgcg tgcatcatct accgcaccaa caagaacgtg
1561 accatcaagc gcaccgagtt catcagatcg ctgggtttga gcatgatcta cgagcacctc
1621 cattcacgga acaagaagaa gaatatccct acttacctga gcagcgtat cgagaagcag
1681 ttgggagaac caagcccgcg ccacgtgaac gtgccggggc gctacgtgcg gtgccaagat
1741 tgcccgtaca aaaaggaccg caaaaccaaa gatcgtgta acgcgtgcgc caaacctatc
1801 tgcatggagc atgccaaatt tctgtgtgaa aattgtgctg aactcgattc ctccctg.
```

In certain embodiments the piggyBac or piggyBac-like transposase is hyperactive. A hyperactive piggyBac or piggyBac-like transposase is a transposase that is more active than the naturally occurring variant from which it is derived. In certain embodiments, the hyperactive piggyBac or piggyBac-like transposase enzyme is isolated or derived from *Bombyx mori*. In certain embodiments, the piggyBac or piggyBac-like transposase is a hyperactive variant of SEQ ID NO: 14505. In certain embodiments, the hyperactive piggyBac or piggyBac-like transposase comprises a sequence that is at least 90% identical to:

```
                                                       (SEQ ID NO: 14576)
  1    MDIERQEERI RAMLEEELSD YSDESSSEDE TDHCSEHEVN YDTEEERIDS VDVPSNSRQE
 61    EANAIIANES DSDPDDDLPL SLVRQRASAS RQMSGPHYTS KDGTKWYKNC QRPNVRLRSE
121    NIVTEQAQVK NIARDASTEY ECWNIFVTSD MLQEILTHTN SSIRWRQTKT AAENSSASTS
181    FYMQETTLCE LKALIGLLYI AGLIKSNRQS LKDLWRTDGT GVDIFRTTMS LQRFQFLQNN
241    IRFDDKSTRD ERKQTDNMAA FRSIFDQFVQ SCQNAYSPSE FLTIDEMLLS FRGRCLFRVY
301    IPNKPAKYGI KILALVDAKN FYVKNLEVYA GKQPSGPYAV SNRPFEVVER LIQPVARSHR
361    NVTFDNWFTG YELMLHLLNE YRLTSVGTVR KNKRQIPESF IRTDRQPNSS VFGFQKDITL
421    VSYARKKNKV VVVMSTMHHD NSIDESTGEK QKPEMITFYN STKAGVDVVD ELCANYNVSR
481    NSKRWPMTLF YGVLNMAAIN ACIIYRTNKN VTIKRTEFIR SLGLSMIYEH LHSRNKKKNI
541    PTYLKRQIEK QLGEPSPRHV NVPGRYVRCQ DCPYKKDRKT KRSCNACAKP ICMEHAKFLC
601    ENCAELDSHL.
```

In certain embodiments, the hyperactive piggyBac or piggyBac-like transposase comprises SEQ ID NO: 14576. In certain embodiments, the hyperactive piggyBac or piggyBac-like transposase comprises a sequence of:

```
                                                       (SEQ ID NO: 14630)
  1    MDIERQEERI RAMLEEELSD YSDESSSEDE TDHCSEHEVN YDTEEERIDS VDVPSNSRQE
 61    EANAIIANES DSDPDDDLPL SLVRQRASAS RQVSGPFYTS KDGTKWYKNC QRPNVRLRSE
121    NIVTEQAQVK NIARDASTEY ECWNIFVTSD MLQEILTHTN SSIRWRQTKT AAENSSAFTS
181    FYMQETTLCE LKALIGLLYI AGLIKSNRQS LKDLWRTDGT GVDIFRTTMS LQRFQFLLNN
241    IRFDDKSTRD ERKQTDNMAA FRSIFDQFVQ SCQNAYSPSE FLTIDEMLLS FRGRCLFRVY
301    IPNKPAKYGI KILALVDAKN FYVHNLEVYA GKQPSGPYAV SNRPFEVVER LIQPVARSHR
361    NVTFDNWFTG YEVMLHLLNE YRLTSVGTVR KNKRQIPESF IRTDRQPNSS VEGFQKDITL
421    VSYAPKKNKV VVVMSTMHHD NSIDESTGEK QKPEMITFYN STKAGVDVVD ELCANYNVSR
481    NSKRWPMTLF YGVLNMAAIN ACIIYRTNKN VTIKRTEFIR SLGLSMIYEH LHSRNKKKNI
541    PTYLRQRIEK QLGEPSPRHV NVPGRYVRCQ DCPYKKDRKT KRSCNACAKP ICMEHAKFLC
601    ENCAHLDS.
```

In certain embodiments, the hyperactive piggyBac or piggyBac-like transposase comprises a sequence of:

```
                                                       (SEQ ID NO: 14631)
  1    MDIERQEERI RAMLEEELSD YSDESSSEDE TDHCSEHEVN YDTEEERIDS VDVPSNSRQE
 61    EANAIIANES DSDPDDDLPL SLVRQRASAS RQVSGPFYTS KDGTKWYKNC QRPNVRLRSE
121    NIVTEQAQVK NIARDASTEY ECWNIFVTSD MLQEILTHTN SSIRWRQTKT AAENSSASTS
181    FYMQETTLCE LKALIGLLYI AGLIKSNRQS LKDLWRTDGT GVDIFRTTMS LQRFQFLLNN
241    IRFDDKSTRD ERKQTDNMAA FRSIFDQFVQ SCQNAYSPSE FLTIDEMLLS FRGRCLFRVY
301    IPNKPAKYGI KILALVDAKN FYVKNLEVYA GKQPSGPYAV SNRPFEVVER LIQPVARSHR
361    NVTFDNWFTG YELMLHLLNE YRLTSVGTVR KNKRQIPESF IRTDRQPNSS VFGFQKDITL
```

```
421  VSYAPKKNKV VVVMSTMHHD NSIDESTGEK QKPEMITFYN STKAGVDVVD ELCANYNVSR

481  NSKRWPMTLF YGVLNMAAIN ACIIYRTNKN VTIKRTEFIR SLGLSMIYEH LHSRNKKKNI

541  PTYLRQRIAM QLGEPSPRHV NVPGRYVRCQ DCPYKKDRKT KRSCNACAKP ICMEHAKFLC

601  ENCAELDSSL.
```

In certain embodiments, the hyperactive piggyBac or piggyBac-like transposase comprises a sequence of:

```
                                                                    (SEQ ID NO: 14632)
  1  MDIERQEERI RAMLEEELSD YSDESSSEDE TDHCSEHEVN YDTEEERIDS VDVPSNSRQE

61  EANAIIANES DSDPDDDLPL SLVRQRASAS RQVSGPFYTS KDGTKWYKNC QRPNVRLRSE

121  NIVTEQAQVK NIARDASTEY ECWNIFVTSD MLQEILTHTN SSIRWRQTKT AAENSSAETS

181  FYMQETTLCE LKALIGLLYI AGLIKSNRQS LKDLWRTDGT GVDIFRTTMS LQRFQFLLNN

241  IRFDDKSTRD ERKQTDNMAA FRSIFDQFVQ SCQNAYSPSE FLTIDEMLLS FRGRCLFRVY

301  IPNKPAKYGI KILALVDAKN FYVKNLEVYA GKQPSGPYAV SNRPFEVVER LIQPVARSHR

361  NVTFDNWFTG YELMLHLLNE YRLTSVGTVR KNKTQIPENF IRTDRQPNSS VFGFQKDITL

421  VSYAPKKNKV VVVMSTMHHD NSIDESTGEK QKPEMITFYN STKAGVDVVD ELQANYNVSR

481  NSKRWPMTLF YGVLNMAAIN ACIIYRTNKN VTIKRTEFIR SLGLSMIYEH LHSRNKKKNI

541  PTYLRQRIEK QLGEPSPRHV NVPGRYVRCQ DCPYKKDRKT KRSCNACAKP ICMEHAKFLC

601  ENCAELDSSL.
```

In certain embodiments, the hyperactive piggyBac or piggyBac-like transposase comprises a sequence of:

```
                                                                    (SEQ ID NO: 14633)
  1  MDIERQEERI RAMLEEELSD YSDESSSEDE TDHCSEHEVN YDTEEERIDS VDVPSNSRQE

61  EANAIIANES DSDPDDDLPL SLVRQRASAS RQVSGPFYTS KDGTKWYKNC QRPNVRLRSE

121  NIVTEQAQVK NIARDASTEY ECWNIFVTSD MLQEILTHTN SSIRWRQTKT AAENSSAETS

181  FYMQETTLCE LKALIGLLYI AGLIKSNRQS LKDLWRTDGT GVDIFRTTMS LQRFQFLQNN

241  IRFDDKSTRD ERKQTDNMAA FRSIFDQFVQ SCQNAYSPSE FLTIDEMLLS FRGRCLFRVY

301  IPNKPAKYGI KILALVDAKN FYVKNLEVYA GKQPSGPYAV SNRPFEVVER LIQPVARSHR

361  NVTFDNWFTG YELMLHLLNE YRLTSVGTVR KNKRQIPESF IRTDRQPNSS VFGFQKDITL

421  VSYAPKKNKV VVVMSTMHHD NSIDESTGEK QKPEMITFYN STKAGVDVVD ELCANYNVSR

481  NSKRWPMTLF YGVLNMAAIN ACIIYRTNKN VTIKRTEFIR SLGLSMIYEH LHSRNKKKNI

541  PTYLRQRIEK QLGEPSPRHV NVPGRYVRCQ DCPYKKDRKT KRSCNACAKP ICMEHAKFLC

601  ENCAELDSSL.
```

In certain embodiments, the hyperactive piggyBac or piggyBac-like transposase comprises a sequence of:

```
                                                                    (SEQ ID NO: 14634)
  1  MDIERQEERI RAMLEEELSD YSDESSSEDE TDHCSEHEVN YDTEEERIDS VDVPSNSRQE

61  EANAIIANES DSDPDDDLPL SLVRQRASAS RQVSGPFYTS KDGTKWYKNC QRPNVRLRSE

121  NIVTEQAQVK NIARDASTEY ECWNIFVTSD MLQEILTHTN SSIRHRQTKT AAENSSAETS

181  FYMQETTLCE LKALIALLYL AGLIKSNRQS LKDLWRTDGT GVDIFRTTMS LQRFQFLQNN

241  IRFDDKSTRD ERKQTDNMAA FRSIFDQFVQ CCQNAYSPSE FLTIDEMLLS FRGRCLFRVY
```

```
301  IPNKPAKYGI KILALVDAKN DYVVNLEVYA GKQPSGPYAV SNRPFEVVER LIQPVARSHR

361  NVTFDNWFTG YELMLHLLNE YRLTSVGTVR KNKRQIPESF IRTDRQPNSS VFGFQKDITL

421  VSYAPKKNKV VVVMSTMHHD NSIDESTGEK QKPEMITFYN STKAGVDVVD ELCANYNVSR

481  NSKRWPMTLF YGVLNMAAIN ACIIYRTNKN VTIKPTEFIR SLGLSMIYEH LHSRNKKKNI

541  PTYLRQRIEK QLGEPSSRHV NVKGRYVRCQ DCPYKKDRKT KRSCNACAKP ICMEHAKFLC

601  ENCAELDSSL.
```

In certain embodiments, the hyperactive piggyBac or piggyBac-like transposase is more active than the transposase of SEQ ID NO: 14505. In certain embodiments, the hyperactive piggyBac or piggyBac-like transposase is at least 90%, at least 95%, at least 9%, at least 97%, at least 98%, or at least 99% or any percentage in between identical to SEQ ID NO: 14505.

In certain embodiments, the hyperactive piggyBac or piggyBac-like transposase comprises an amino acid substitution at a position selected from 92, 93, 96, 97, 165, 178, 189, 196, 200, 201, 211, 215, 235, 238, 246, 253, 258, 261, 263, 271, 303, 321, 324, 330, 373, 389, 399, 402, 403, 404, 448, 473, 484, 507, 523, 527, 528, 543, 549, 550, 557, 601, 605, 607, 609, 610 or a combination thereof (relative to SEQ ID NO: 14505). In certain embodiments, the hyperactive piggyBac or piggyBac-like transposase comprises an amino acid substitution of Q92A, V93L, V93M, P96G, F97H, F97C, H165E, H165W, E178S, E178H, C189P, A196G, L200I, A201Q, L211A, W215Y, G219S, Q235Y, Q235G, Q238L, K246I, K253V, M258V, F261L, S263K, C271S, N303R, F321W, F321D, V324K, V324H, A330V, L373C, L373V, V389L, S399N, R402K, T403L, D404Q, D404S, D404M, N441R, G448W, E449A, V469T, C473Q, R484K T507C, G523A, I527M, Y528K Y543I, E549A, K550M, P557S, E601V, E605H, E605W, D607H, S609H, L610I or any combination thereof. In certain embodiments, the hyperactive piggyBac or piggyBac-like transposase comprises an amino acid substitution of Q92A, V93L, V93M, P96G, F97H, F97C, H165E, H165W, E178S, E178H, C189P, A196G, L200I, A201Q, L211A, W215Y, G219S, Q235Y, Q235G, Q238L, K246I, K253V, M258V, F261L, S263K, C271S, N303R, F321W, F321D, V324K, V324H, A330V, L373C, L373V, V389L, S399N, R402K, T403L, D404Q, D404S, D404M, N441R, G448W, E449A, V469T, C473Q, R484K T507C, G523A, I527M, Y528K Y543I, E549A, K550M, P557S, E601V, E605H, E605W, D607H, S609H and L610I.

In certain embodiments, the hyperactive piggyBac or piggyBac-like transposase comprises one or more substitutions of an amino acid that is not wild type, wherein the one or more substitutions a for wild type amino acid comprises a substitution of E4X, A12X, M13X, L14X, E15X, D20X, E24X, S25X, S26X, S27X, D32X, H33X, E36X, E44X, E45X, E46X, I48X, D49X, R58X, A62X, N63X, A64X, I65X, I66X, N68X, E69X, D71X, S72X, D76X, P79X, R84X, Q85X, A87X, S88X, Q92X, V93X, S94X, G95X, P96X, F97X, Y98X, T99X, I145X, S149X, D150X, L152X, E154X, T157X, N160X, S161 X, S162X, H165X, R166X, T168X, K169X, T170X, A171X, E173X, S175X, S176X, E178X, T179X, M183X, Q184X, T186X, T187X, L188X, C189X, L194X, I195X, A196X, L198X, L200X, A201X, L203X, I204X, K205X, A206X, N207X, Q209X, S210X, L211X, K212X, D213X, L214X, W215X, R216X, T217X, G219X, V222X, D223X, I224X, T227X, M229X, Q235X, L237X, Q238X, N239X, N240X, P302X, N303X, P305X, A306X, K307X, Y308X, I310X, K311X, I312X, L313X, A314X, L315X, V316X, D317X, A318X, K319X, N320X, F321X, Y322X, V323X, V324X, L326X, E327X, V328X, A330X, Q333X, P334X, S335X, G336X, P337X, A339X, V340X, S341X, N342X, R343X, P344X, F345X, E346X, V347X, E349X, I352X, Q353X, V355X, A356X, R357X, N361X, D365X, W367X, T369X, G370X, L373X, M374X, L375X, H376X, N379X, E380X, R382X, V386X, V389X, N392X, R394X, Q395X, S399X, F400X, I401X, R402X, T403X, D404X, R405X, Q406X, P407X, N408X, S409X, S410X, V411X, F412X, F414X, Q415X, I418X, T419X, L420X, N428X V432X, M434X, D440X, N441X, S442X, I443X, D444X, E445X, G448X, E449X, Q451X, K452X, M455X, I456X, T457X, F458X, S461X, A464X, V466X, Q468X, V469X, E471X, L472X, C473X, A474X, K483X, W485X, T488X, L489X, Y491X, G492X, V493X, M496X, I499X, C502X, I503X, T507X, K509X, N510X, V511X, T512X, I513X, R515X, E517X, S521X, G523X, L524X, S525X, I527X, Y528X, E529X, H532X, S533X, N535X, K536X, K537X, N539X, I540X, T542X, Y543X, Q546X, E549X, K550X, Q551X, G553X, E554X, P555X, S556X, P557X, R558X, H559X, V560X, N561X, V562X, P563X, G564X, R565X, Y566X, V567X, Q570X, D571X, P573X, Y574X, K576X, K581X, S583X, A586X, A588X, E594X, F598X, L599X, E601X, N602X, C603X, A604X, E605X, L606X, D607X, S608X, S609X or L610X (relative to SEQ ID NO: 14505). A list of hyperactive amino acid substitutions can be found in U.S. Pat. No. 10,041,077, the contents of which are incorporated herein by reference in their entirety.

In certain embodiments, the piggyBac or piggyBac-like transposase is integration deficient. In certain embodiments, an integration deficient piggyBac or piggyBac-like transposase is a transposase that can excise its corresponding transposon, but that integrates the excised transposon at a lower frequency than a corresponding wild type transposase. In certain embodiments, the piggyBac or piggyBac-like transposase is an integration deficient variant of SEQ ID NO: 14505.

In certain embodiments, the excision competent, integration deficient piggyBac or piggyBac-like transposase comprises one or more substitutions of an amino acid that is not wild type, wherein the one or more substitutions a for wild type amino acid comprises a substitution of R9X, A12X, M13X, D20X, Y21K, D23X, E24X, S25X, S26X, S27X, E28X, E30X, D32X, H33X, E36X, H37X, A39X, Y41X, D42X, T43X, E44X, E45X, E46X, R47X, D49X, S50X, S55X, A62X, N63X, A64X, I66X, A67X, N68X, E69X, D70X, D71X, S72X, D73X, P74X, D75X, D76X, D77X, I78X, S81 X, V83X, R84X, Q85X, A7X, S88X, A89X, S90X, R91X, Q92X, V93X, S94X, G95X, P96X, F97X, Y98X, T99X, W012X, G103X, Y107X, K108X, L117X, I122X, Q128X, I312X, D135X, S137X, E139X, Y140X, I145X, S149X, D150X, Q153X, E154X, T157X, S61X, S162X, R164X, H165X, R166X, Q167X, T168X, K169X, T170X, A171X, A172X, E173X, R174X, S175X, S176X, A177X, E178X, T179X, S180X, Y182X, Q184X, E185X, T187X, L188X, C189X, L194X, I195X, A196X, L198X, L200X, A201X, L203X, I204X, K205X, N207X, Q209X, L21X, D213X, L214X, W215X, R216X, T217X, G219X, T220X, V222X, D223X, I224X, T227X, T228X, F234X, Q235X, L237X, Q238X, N239X, N240X, N303X, K304X, I310X, I312X, L313X, A314X, L315X, V316X, D317X, A318X, K319X, N320X, F321X, Y322X, V323X, V324X, N325X, L326X, E327X, V328X, A330X, G331X, K332X, Q333X, S335X, P337X, P344X, F345X, E349X, H359X, N361X, V362X, D365X, F368X, Y371X, E372X, L373X, H376X, E380X, R382X, R382X, V386X, G387X, T388X, V389X, K391X, N392X, R394X, Q395X, E398X, S399X, F400X, I401X, R402X T403X, D404X, R405X, Q406X, P407X, N408X, S409X, S410X, Q415X, K416X, A424X, K426X, N428X, V430X, V432X, V433X, M434X, D436X, D440X, N441X, S442X, I443X, D444X, E445X, S446X, 0,447X, G448X, E449X, K450X, Q451X, E454X, M455X, I456X, T457X, F458X, S461X, A464X, V466X, Q468X, V469X, C473X, A474X, N475X, N477X, K483X, R484X, P486X, T488X, L489X, G492X, V493X, M496X, I499X, I503X, Y505X, T507X, N510X, V511X, T512X, I513X, K514X, T516X, E517X, S521X, G523X, L524X, S525X, I527X, Y528X, L531X, H532X, S533X, N535X, I540X, T542X, Y543X, R545X, Q546X, E549X, L552X, G553X, E554X, P555X, S556X, P557X, R558X, H559X, V560X, N561X, V562X, P563X, G564X, V567X, Q570X, D571X, P573X, Y574X, K575X, K576X, N585X, A586X, M593X, K596X, E60X, N602X, A604X, E605X, L606X, D607X, S608X, S609X or L610X (relative to SEQ ID NO: 14505). A list of integration deficient amino acid substitutions can be found in U.S. Pat. No. 10,041,077, the contents of which are incorporated by reference in their entirety.

In certain embodiments, the integration deficient piggyBac or piggyBac-like transposase comprises a sequence of:

(SEQ ID NO: 14606)
```
  1  MDIERQEERI RAMLEEELSD YSDESSSEDE TDHCSEHEVN YDTEEERIDS VDVPSNSRQE
 61  EANAIIANES DSDPDDDLPL SLVRQRASAS RQVSSPFYTS KDGTKWYKNC QRPNVRLRSE
121  NIVTEQAQVK NIARDASTEY ECWNIFVTSD MLQEILTHTN SSIRHRQTKT AAENSSAETS
181  FYMQETTLCE LKALIALLYL AGLIKSNRQS LKDLWRKDGT GVDIFRTTMS LQRFQFLLNN
241  IRFDDISTRD ERKQTDNMAA FRSIFDQFVQ CCQNAYSPSE FLTIDEMLLS FRGRCLFRVY
301  IPNKPAKYGI KILALVDAKN FYVVNLEVYA GKQPSGPYAV SNRPFEVVER LIQPVARSHR
361  NVTFDNWFTG YELMLHLLNE YRLTSVGTVR KNKRQIPESF IRTDRQPNSS VFGFQKDITL
421  VSYAPKKNKV VVVMSTMHHD NSIDESTGEK QKPEMITFYN STKAGVDVVD ELCANYNVSR
481  NSKKWPMTLF YGVLNMAAIN ACIIYRTNKN VTIKRTEFIR SLGLSMMYEH LHSRNKKKNI
541  PTYLQQRIEK QLGEPVPRHV NVPGRYVRCQ DCPYKKDRKT KRSCNACAKP ICMEHAKFLC
601  ENCAELDSSL.
```

In certain embodiments, the integration deficient piggyBac or piggyBac-like transposase comprises a sequence of:

(SEQ ID NO: 14607)
```
  1  MDIERQEERI RAMLEEELSD YSDESSSEDE TDHCSEHEVN YDTEEERIDS VDVPSNSRQE
 61  EANAIIANES DSDPDDDLPL SDVRQRASAS RQVSGPFYTS KDGTKWYKNC QRPNVRLRSE
121  NIVTEQAQVK NIARDASTEY ECWNIFVTSD MLQEILTHTN SSIRHRQTKT AAENSSAETS
181  FYMQETTLCE LKALIGLLYL AGLIKSNRQS LKDLWRTDGT GVDIFRTTMS LQRFYFLQNN
241  IRFDDKSTLD ERKQTDNMAA FRSIFDQFVQ SCQNAYSPSE FLTIDEMLLS FRGRCLFRVY
301  IPNKPAKYGI KILALVDAKN FYVVNLEVYA GKQPSGPYAV SNRPFEVVER LIQPVARSHR
361  NVTFDNWFTG YELMLHLLNE YRLTSVGTVR KNKRQIPESF IRTDRQPNSS VFGFQKDITL
421  VSYAPKKNKV VVVMSTMHHD NSIDESTGEK QKPEMITFYN STKAGVDVVD ELCANYNVSR
481  NSKRWPMTLF YGVLNMAAIN ACIIYPTNKN VTIKRTEFIR SLGLSMIYEH LHSRNKKKNI
541  PTYLRQRIEK QLGEPSPRHV NYPGRYVRCQ DCPYKKDRKT KRSCNACAKP ICMEHAKFLC
601  VNCAELDSSL.
```

In certain embodiments, the piggyBac or piggyBac-like transposase that is integration deficient comprises a sequence of:

```
                                                               (SEQ ID NO: 14608)
   1  MDIERQEERI RAMLEEELSD YSDESSSEDE TDHCSEHEVN YDTEEERIDS VDVPSNSRQE

61  EANAIIANES DSDPDDDLPL SLVPQRASAS RQVSGPFYTS KDGTKWYKNC QPPNVLRRSE

121  NIVTEQAQVK NIARDASTEY ECWNIFVTSD MLQEILTHTN SSIRHRQTKT AAENSSAETS

181  FYMQETTLCE LKALIALLYL AGLIKSNRQS LKDLWRKDGT GVDIFRTTMS LQRFQFLLNN

241  IRFDDKSTRD ERKQTDNMAA FRSIFDQFVQ CCQNAYSPSE FLTIDEMLLS FRGRCLFRVY

301  IPNKPAKYGI KILALVDAKN DYVVNLEVYA GKQPSGPYAV SNRPFEVVER LIQPVARSHR

361  NVTFDNWFTG YECMLHLLNE YRLTSVGTVR KNKRQIPESF IRTDRQPNSS VFGFQKDITL

421  VSYAPKKNKV VVVMSTMHHD NSIDESTGEK QKPEMITFYN STKAGVDVVD ELCANYNVSR

421  NSKKWPMTLF YGVLNMAAIN ACIIYRTNKN VTIKRTEFIR SLGLSMIKEH LHSRNKKKNI

541  PTYLRQRIEK QLGEPSPRHV NVPGRYVRCQ DCPYRKDRKT KRSCNACAKP ICMEHAKFLC

601  ENCAELDSSL.
```

In certain embodiments, the integration deficient transposase comprises a sequence that is at least 90% identical to SEQ ID NO: 14608.

In certain embodiments, the piggyBac or piggyBac-like transposon is isolated or derived from *Bombyx mori*. In certain embodiments, the piggyBac or piggyBac-like transposon comprises a sequence of:

```
                                                               (SEQ ID NO: 14506)
   1  ttatcccggc gagcatgagg cagggtatct cataccatgg taaaatttta aagttgtgta 61  ttttataaaa ttttcgtctg acaacactag cgcgctcagt agctggaggc aggagcgtgc 121  gggaggggat agtggcgtga tcgcagtgtg gcacgggaca ccggcgagat attcgtgtgc 181  aaacctgttt cgggtatgtt ataccctgcc tcattgttga cgtattttt ttatgtaatt 241  tttccgatta ttaatttcaa ctgttttatt ggtatttta tgttatccat tgttcttttt 301  ttatgattta ctgtatcggt tgtctttcgt tcctttagtt gagttttttt ttattatttt 361  cagttttga tcaaa.
```

In certain embodiments, the piggyBac or piggyBac-like transposon comprises a sequence of:

```
   1  tcatatttt agtttaaaaa aataattata tgttttataa tgaaaagaat ctcattatct 61  ttcagtatta ggttgattta tattccaaag aataatattt ttgttaaatt gttgattttt 121  gtaaacctct aaatgtttgt tgctaaaatt actgtgttta agaaaaagat taataaataa 181  taataatttc ataattaaaa acttctttca ttgaatgcca ttaaataaac cattatttta 241  caaaataaga tcaacataat tgagtaaata ataataagaa caatattata gtacaacaaa 301  atatgggtat gtcatacccct gccacattct tgatgtaact ttttttcacc tcatgctcgc 361  cgggttat
```

In certain embodiments, the piggyBac or piggyBac-like transposon comprises a sequence of:

```
                                                      (SEQ ID NO: 14508)
  1  ttatcccggc gagcatgagg cagggtatct catacgcctgg taaaatttta aagttgtgta 61  ttttataaaa ttttggtctg acaacactag cgcgctcagt aggtggaggc aggagcgtgg 121  gggaggggat agtggcgtga tggcagtgtg gcacgggaca ccggcgagat attcgtgtgc 181  aaacctgttt cgggtatgtt ataccctgcc tcat.
```

In certain embodiments, the piggyBac™ (PB) or piggyBac-like transposon comprises a sequence of:

```
                                                      (SEQ ID NO: 14509)
  1  taaataataa taatttcata attaaaaact tctttcattg aatgccatta aataaaccat 61  tattttacaa aataagatca acataattga gtaaataata ataagaacaa tattatagta 121  caacaaaata tgggtatgtc ataccctgcc acattcttga tgtaactttt tttcacctca 181  tgctcgccgg gttat.
```

In certain embodiments, the piggyBac or piggyBac-like transposon comprises a left sequence corresponding to SEQ ID NO: 14506 and a right sequence corresponding to SEQ ID NO: 14507. In certain embodiments, one piggyBac or piggyBac-like transposon end is at least 85%, at least 90%, at least 95%, at least 98%, at least 990% identical or any percentage in between identical to SEQ ID NO: 14506 and the other piggyBac or piggyBac-like transposon end is at least 85%, at least 90%, at least 95%, at least 98%, at least 99% or any percentage in between identical to SEQ ID NO: 14507. In certain embodiments, the piggyBac or piggyBac-like transposon comprises SEQ ID NO: 14506 and SEQ ID NO: 14507 or SEQ ID NO: 14509. In certain embodiments, the piggyBac or piggyBac-like transposon comprises SEQ ID NO: 14508 and SEQ ID NO: 14507 or SEQ ID NO: 14509. In certain embodiments, the left and right transposon ends share a 16 bp repeat sequence at their ends of CCCGGCGAGCATGAGG (SEQ ID NO: 14510) immediately adjacent to the 5'-TTAT-3 target insertion site, which is inverted in the orientation in the two ends. In certain embodiments, left transposon end begins with a sequence comprising 5'-TTATCCCGGCGAGCATGAGG-3 (SEQ ID NO: 14511), and the right transposon ends with a sequence comprising the reverse complement of this sequence: 5'-CCTCATGCTCGCCGGGTTAT-3' (SEQ ID NO: 14512).

In certain embodiments, the piggyBac or piggyBac-like transposon comprises one end comprising at least 14, 16, 18, 20, 30 or 40 contiguous nucleotides of SEQ ID NO: 14506 or SEQ ID NO: 14508. In certain embodiments, the piggyBac or piggyBac-like transposon comprises one end comprising at least 14, 16, 18, 20, 30 or 40 contiguous nucleotides of SEQ ID NO: 14507 or SEQ ID NO: 14509. In certain embodiments, the piggyBac or piggyBac-like transposon comprises one end with at least 90% identity to SEQ ID NO: 14506 or SEQ ID NO: 14508. In certain embodiments, the piggyBac or piggyBac-like transposon comprises one end with at least 90% identity to SEQ ID NO: 14507 or SEQ ID NO: 14509.

In certain embodiments, the piggyBac or piggyBac-like transposon comprises a sequence of:

```
                                                      (SEQ ID NO: 14515)
  1  ttaacccggc gagcatgagg cagggtatct catacgcctgg taaaatttta aagttgtgta 61  ttttataaaa ttttcgtctg acaacactag cgcgctcagt agctggaggc aggagcgtgc 121  gggaggggat agtggcgtga tcgcagtgtg gcacgggaca ccggcgagat attcgtgtgc 181  aaacctgttt cgggtatgtt ataccctgcc tcattgttga cgtatttttt ttatgtaatt 241  tttccgatta ttaatttcaa ctgttttatt ggtattttta tgttatccat tgttcttttt 301  ttatgattta ctgtatcggt tgtctttcgt tcctttagtt gagttttttt ttattatttt 361  cagtttttga tcaaa.
```

In certain embodiments, the piggyBac or piggyBac-like transposon comprises a sequence of:

```
                                                      (SEQ ID NO: 14516)
  1  tcatatttttt agtttaaaaa aataattata tgttttataa tgaaaagaat ctcattatct 61  ttcagtatta ggttgattta tattccaaag aataatattt ttgttaaatt gttgattttt 121  gtaaacctct aaatgtttgc tgctaaaatt actgtgttta agaaaaagat taataaataa 181  taataatttc ataattaaaa acttctttca ttgaatgcca ttaaataatt cattattta 241  caaaataaga tcaacataac tgagtaaata ataataagaa caatattata gtacaacaaa
```

-continued

```
301    atatgggtat gtcataccct tttttttttt tttttttttt ttctttcggg tagagggccg 361    aacctcctac gaggtccccg cgcaaaaggg gcgcgcgggg tatgtgagac tcaacgatct 421    gcatggtgtt gtgagcagac cgcgggccca aggattttag agcccaccca ctaaacgact 481    cctctgcact cttacaccc acgtccgatc ccctccgagg tcagaacccg gatgaggtag 541    gggggctacc gcggtcaaca ctacaaccag acggcgcggc tcaccccaag gacgcccagc 601    cgacggagcc ttcgaggcga atcgaaggct ctgaaacgtc ggccgtctcg gtacggcagc 661    ccgtcgggcc gcccagacgg tgccgctggt gtcccggaat accccgctgg accagaacca 721    gcctgccggg tcgggacgcg atacaccgtc gaccggtcgc tccaatcact ccacggcagc 721    gcgctagagt gctggta.
```

In certain embodiments, the piggyBac or piggyBac-like transposon comprises a sequence of CCCGGCGAGCATGAGG (SEQ ID NO: 14510). In certain embodiments, the piggyBac or piggyBac-like transposon comprises an ITR sequence of SEQ ID NO: 14510. In certain embodiments, the piggyBac or piggyBac-like transposon comprises a sequence of TTATCCCGGCGAGCATGAGG (SEQ ID NO: 14511). In certain embodiments, the piggyBac or piggyBac-like transposon comprises at least 16 contiguous nucleotides from SEQ 1D NO: 14511. In certain embodiments, the piggyBac or piggyBac-like transposon comprises a sequence of CCTCATGCTCGCCGGGTTAT (SEQ ID NO: 14512). In certain embodiments, the piggyBac or piggyBac-like transposon comprises at least 16 contiguous nucleotides from SEQ ID NO: 14512. In certain embodiments, the piggyBac or piggyBac-like transposon comprises one end comprising at least 16 contiguous nucleotides from SEQ ID NO: 14511 and one end comprising at least 16 contiguous nucleotides from SEQ ID NO: 14512. In certain embodiments, the piggyBac or piggyBac-like transposon comprises SEQ ID NO: 14511 and SEQ ID NO: 14512. In certain embodiments, the piggyBac or piggyBac-like transposon comprises a sequence of TTAACCCGGCGAGCATGAGG (SEQ ID NO 14513). In certain embodiments, the piggyBac or piggyBac-like transposon comprises a sequence of CCTCATGCTCGCCGGGTTAA (SEQ ID NO: 14514).

In certain embodiments, the piggyBac or piggyBac-like transposon may have ends comprising SEQ ID NO: 14506 and SEQ ID NO: 14507, or a variant of either or both of these having at least 90% sequence identity to SEQ ID NO: 14506 or SEQ ID NO: 14507, and the piggyBac or piggyBac-like transposase has the sequence of SEQ ID NO: 14504 or SEQ ID NO: 14505, or a sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identity to SEQ ID NO: 14504 or SEQ ID NO: 14505. In certain embodiments, the piggyBac or piggyBac-like transposon comprises a heterologous polynucleotide inserted between a pair of inverted repeats, where the transposon is capable of transposition by a piggyBac or piggyBac-like transposase having at least 5%, 10%, 15%, 20%, 25%, 30%, 35%. 40%, 45%, 50%, 55%, 60%, 65%, 70%, 75%, 80%, 85%, 90%, 95%, 99% or any percentage in between identity to SEQ ID NO: 14504 or SEQ ID NO: 14505. In certain embodiments, the transposon comprises two transposon ends, each of which comprises SEQ ID NO: 14510 in inverted orientations in the two transposon ends. In certain embodiments, each inverted terminal repeat (ITR) is at least 90% identical to SEQ ID NO: 14510.

In certain embodiments, the piggyBac or piggyBac-like transposon is capable of insertion by a piggyBac or piggyBac-like transposase at the sequence 5'-TTAT-3' within a target nucleic acid. In certain embodiments, one end of the piggyBac or piggyBac-like transposon comprises at least 16 contiguous nucleotides from SEQ ID NO: 14506 and the other transposon end comprises at least 16 contiguous nucleotides from SEQ ID NO: 14507 In certain embodiments, one end of the piggyBac or piggyBac-like transposon comprises at least 17, at least 18, at least 19, at least 20, at least 22, at least 25, at least 30 contiguous nucleotides from SEQ ID NO: 14506 and the other transposon end comprises at least 17, at least 18, at least 19, at least 20, at least 22, at least 25, at least 30 contiguous nucleotides from SEQ ID NO: 14507.

In certain embodiments, the piggyBac or piggyBac-like transposon comprises transposon ends (each end comprising an ITR) corresponding to SEQ ID NO: 14506 and SEQ ID NO: 14507, and has a target sequence corresponding to 5'-TTAT3'. In certain embodiments, the piggyBac or piggyBac-like transposon also comprises a sequence encoding a transposase (e.g. SEQ ID NO: 14505). In certain embodiments, the piggyBac or piggyBac-like transposon comprises one transposon end corresponding to SEQ ID NO: 14506 and a second transposon end corresponding to SEQ ID NO: 14516. SEQ ID NO: 14516 is very similar to SEQ ID NO: 14507, but has a large insertion shortly before the ITR. Although the ITR sequences for the two transposon ends are identical (they are both identical to SEQ ID NO: 14510), they have different target sequences: the second transposon has a target sequence corresponding to 5'-TTAA-3', providing evidence that no change in ITR sequence is necessary to modify the target sequence specificity. The piggyBac or piggyBac-like transposase (SEQ ID NO: 14504), which is associated with the 5'-TTAA-3' target site differs from the 5'-TTAT-3'-associated transposase (SEQ ID NO: 14505) by only 4 amino acid changes (D322Y, S473C, A507T, H582R). In certain embodiments, the piggyBac or piggyBac-like transposase (SEQ ID NO: 14504), which is associated with the 5'-TTAA-3' target site is less active than the 5'-TTAT-3'-associated piggyBac or piggyBac-like transposase (SEQ ID NO: 14505) on the transposon with 5'-TTAT-3' ends. In certain embodiments, piggyBac or piggyBac-like transposons with 5'-TTAA-3' target sites can be converted to piggyBac or piggyBac-like transposases with 5'-TTAT-3 target sites by replacing 5'-TTAA-3' target sites with 5'-TTAT-3'. Such transposons can be used either with a piggyBac or piggyBac-like transposase such as SEQ ID NO: 14504 which recognizes the 5'-TTAT-3' target sequence, or with a variant of a transposase originally associated with the 5'-TTAA-3' transposon. In certain embodiments, the high similarity between the 5'-TTAA-3' and 5'-TTAT-3' piggyBac or piggyBac-like transposases demonstrates that very few changes to the amino acid sequence of a piggyBac or piggyBac-like transposase alter target sequence specificity. In certain embodiments, modification of any piggyBac or piggyBac-like transposon-transposase gene transfer system, in which 5'-TTAA-3' target sequences are replaced with 5'-TTAT-3'-target sequences, the ITRs remain the same, and the transposase is the original piggyBac or piggyBac-like transposase or a variant thereof resulting from using a low-level mutagenesis to introduce mutations into the transposase. In certain embodiments, piggyBac or piggyBac-like transposon transposase transfer systems can be formed by the modification of a 5'-TTAT-3'-active piggyBac or piggyBac-like transposon-transposase gene transfer systems in which 5'-TTAT-3' target sequences are replaced with 5'-TTAA-3'-target sequences, the ITRs remain the same, and the piggyBac or piggy Bac-like transposase is the original transposase or a variant thereof.

In certain embodiments, the piggyBac or piggyBac-like transposon is isolated or derived from *Bombyx mori*. In certain embodiments, the piggyBac or piggyBac-like transposon comprises a sequence of:

(SEQ ID NO: 14577)
```
  1 cccggcgagc atgaggcagg gtatctcata ccctggtaaa attttaaagt tgtgtatttt
 61 ataaaatttt cgtctgacaa cactagcgcg ctcagtagct ggaggcagga gcgtgcggga
121 ggggatagtg gcgtgatcgc agtgtggcac gggacaccgg cgagatattc gtgtgcaaac
181 ctgtttcggg tatgttatac cctgcctcat tgttgacgta t.
```

In certain embodiments, the piggyBac or piggyBac-like transposon comprises a sequence of:

(SEQ ID NO: 14578)
```
  1 tttaagaaaa agattaataa ataataataa tttcataatt aaaaacttct ttcattgaat
 61 gccattaaat aaaccattat tttacaaaat aagatcaaca taattgagta aataataata
121 agaacaatat tatagtacaa caaaatatgg gtatgtcata ccctgccaca ttcttgatgt
181 aactttttt cacctcatgc tcgccggg.
```

In certain embodiments, the transposon comprises at least 16 contiguous bases from SEQ ID NO: 14577 and at least 16 contiguous bases from SEQ ID NO: 14578, and inverted terminal repeats that are at least 87% identical to CCCGGCGAGCATGAGG (SEQ ID NO: 14510). In certain embodiments, the piggyBac or piggyBac-like transposon comprises a sequence of:

(SEQ ID NO: 14595)
```
  1 cccggcgagc atgaggcagg gtatctcata ccctggtaaa attttaaagt tgtgtatttt
 61 ataaaatttt cgtctgacaa cactagcgcg ctcagtagct ggaggcagga gcgtgcggga
121 ggggatagtg gcgtgatcgc agtgtggcac gggacaccgg cgagatattc gtgtgcaaac
181 ctgtttccgg tatgttatac cctgcctcat tgttgacgta ttttttttat gtaatttttc
241 cgattattaa tttcaactgt tttattggta tttttatgtt atccattgtt ctttttttat
301 gatttactgt atcggttgtc tttcgttcct ttagttgagt ttttttttat tattttcagt
361 ttttgatcaa a.
```

In certain embodiments, the piggyBac or piggyBac-like transposon comprises a sequence of:

(SEQ ID NO: 14596)
```
  1 tcatattttt agtttaaaaa aataattata tgttttataa tgaaaagaat ctcattatct
 61 ttcagtatta ggttgattta tattccaaag aataatattt ttgttaaatt gttgattttt
121 gtaaacctct aaatgtttgt tgctaaaatt actgtgttta agaaaagat taataaataa
181 taataatttc ataattaaaa acttctttca ttgaatgcca ttaaataaac cattatttta
241 caaaataaga tcaacataat tgagtaaata ataataagaa caatattata gtacaacaaa
```

-continued

```
301 atatgggtat gtcataccct gccacattct tgatgtaact ttttttcacc tcatgctcgc 361 cggg.
```

In certain embodiments, the piggyBac or piggyBac-like transposon comprises SEQ ID NO: 14595 and SEQ ID NO: 14596, and is transposed by the piggyBac or piggyBac-like transposase of SEQ ID NO: 14505. In certain embodiments, the ITRs of SEQ ID NO: 14595 and SEQ ID: 14596 are not flanked by a 5'-TTAA-3' sequence. In certain embodiments, the ITRs of SEQ ID NO: 14595 and SEQ ID: 14596 are flanked by a 5'-TTAT-3' sequence.

In certain embodiments, the piggyBac or piggyBac-like transposon comprises a sequence of:

```
                                                                  (SEQ ID NO: 14597)
  1  cccggcgagc atgaggcagg gtatctcata ccctggtaaa attttaaagt tgtgtatttt 61  ataaaatttt cgtctgacaa cactagcgcg ctcagtagct ggaggcagga gcgtgcggga 121  ggggatagtg gcgtgatcgc agtgtggcac gggacaccgg cgagatattc gtgtgcaaac 181  ctgtttcggg tatgttatac cctgcctcat tgttgacgta ttttttttat gtaattttc 241  cgattattaa tttcaactgc tttattggta tttttatgtt atccattgtt cttttttat 301  g.
```

In certain embodiments, the piggyBac or piggyBac-like transposon comprises a sequence of:

```
                                                                  (SEQ ID NO: 14598)
  1  cagggtatct catacctgg taaaatttta aagttgtgta ttttataaaa ttttcgtctg 61  acaacactag cgcgctcagt agctggaggc aggagcgtgc gggaggggat agtggcgtga 121  tcgcagtgtg gcacgggaca ccggcgagat attcgtgtgc aaacctgttt cgggtatgtt 181  ataccctgcc tcattgttga cgtattttt ttatgtaatt tttccgatta ttaatttcaa 241  ctgttttatt ggtattttta tgttatccat tgttcttttt ttatg.
```

In certain embodiments, the piggyBac or piggyBac-like transposon comprises a sequence of:

```
                                                                  (SEQ ID NO: 14599)
  1  cagggtatct catacctgg taaaatttta aagttgtgta ttttataaaa ttttcgtctg 61  acaacactag cgcgctcagt agctggaggc aggagcgtgc gggaggggat agtggcgtga 121  tcgcagtgtg gcacgggaca ccggcgagat attcgtgtgc aaacctgttt cgggtatgtt 181  ataccctgcc tcattgttga cgtat.
```

In certain embodiments, the left end of the piggyBac or piggyBac-like transposon comprises a sequence of SEQ ID NO: 14577, SEQ ID NO: 14595, or SEQ ID NOs: 14597-14599. In certain embodiments, the left end of the piggyBac or piggyBac-like transposon is preceded by a left target sequence.

In certain embodiments, the piggyBac or piggyBac-like transposon comprises a sequence of:

```
                                                          (SEQ ID NO: 14600)
  1  tcatattttt agtttaaaaa aataattata tgttttataa tgaaaagaat ctcattatct 61  ttcagtatta ggttgattta tattccaaag aataatattt ttgttaaatt gttgattttt 121  gtaaacctct aaatgtttgt tgctaaaatt actgtgttta agaaaaagat taataaataa 181  taataatttc ataattaaaa acttctttca ttgaatgcca ttaaataaac cattatttta 241  caaaataaga tcaacataat tgagtaaata ataataagaa caatattata gtacaacaaa 301  atatgggtat gtcatacccct gccacattct tgatgtaact ttttttcacc tcatgctcgc 351  cggg.
```

In certain embodiments the piggyBac or piggyBac-like transposon comprises a sequence of:

sequence that is at least 90%, at least 95% or at least 99% or any percentage in between identical to SEQ ID NO:

```
                                                          (SEQ ID NO: 14601)
  1  tttaagaaaa agattaataa ataataataa tttcataatt aaaaacttct ttcattgaat 61  gccattaaat aaaccattat tttacaaaat aagatcaaca taattgagta aataataata 121  agaacaatat tatagtacaa caaaatatgg gtatgtcata ccctgccaca ttcttgatgt 181  aacttttttt ca.
```

In certain embodiments, the piggyBac or piggyBac-like transposon comprises a sequence of:

14577 and one end that comprises a sequence that is at least 90%, at least 95% or at least 99% or any percentage in

```
                                                          (SEQ ID NO: 14602)
  1    cccggcgagc atgaggcagg gtatctcata ccctggtaaa attttaaagt tgtgtatttt 61    ataaaatttt cgtctgacaa cactagcgcg ctcagtagct ggaggcagga gcgtgcggga 121    ggggatagtg gcgtgatcgc agtgtggcac gggacaccgg cgagatattc gtgtgcaaac 181    ctgtttcggq tatgttatac cctgcctcat tgttgacgta ttttttttat gtaattttc 241    cgattattaa tttcaactgt tttattggta ttttatgtt atccattgtt cttttttat 301    gatttactgt atcggttgtc tttcgttcct ttagttgagt ttttttttat tattttcagt 361    ttttgatcaa a.
```

In certain embodiments, the right end of the piggyBac or piggyBac-like transposon comprises a sequence of SEQ ID NO: 14578, SEQ ID NO: 14596, or SEQ ID NOs: 14600-14601. In certain embodiments, the right end of the piggyBac or piggyBac-like transposon is followed by a right target sequence. In certain embodiments, the transposon is transposed by the transposase of SEQ ID NO: 14505 In certain embodiments, the left and right ends of the piggyBac or piggyBac-like transposon share a 16 bp repeat sequence of SEQ ID NO: 14510 in inverted orientation and immediately adjacent to the target sequence. In certain embodiments, the left transposon end begins with SEQ ID NO: 14510, and the right transposon end ends with the reverse complement of SEQ ID NO: 14510, 5'-CCTCATGCTCGCCGGG-3' (SEQ ID NO: 14603). In certain embodiments, the piggyBac or piggyBac-like transposon comprises an ITR with at least 93%, at least 87%, or at least 81% or any percentage in between identity to SEQ ID NO: 14510 or SEQ ID NO: 14603. In certain embodiments, the piggyBac or piggyBac-like transposon comprises a target sequence followed by a left transposon end comprising a sequence selected from SEQ ID NOs: 88, 105 or 107 and a right transposon end comprising SEQ ID NO: 14578 or 106 followed by a target sequence, in certain embodiments, the piggyBac or piggyBac like transposon comprises one end that comprises a between identical to SEQ ID NO: 14578. In certain embodiments, one transposon end comprises at least 14, at least 16, at least 18 or at least 20 contiguous bases from SEQ ID NO: 14577 and one transposon end comprises at least 14, at least 16, at least 18 or at least 20 contiguous bases from SEQ ID NO: 14578.

In certain embodiments, the piggyBac or piggyBac-like transposon comprises two transposon ends wherein each transposon ends comprises a sequence that is at least 81% identical, at least 87% identical or at least 93% identical or any percentage in between identical to SEQ ID NO: 14510 in inverted orientation in the two transposon ends. One end may further comprise at least 14, at least 16, at least 18 or at least 20 contiguous bases from SEQ ID NO: 14599, and the other end may further comprise at least 14, at least 16, at least 18 or at least 20 contiguous bases from SEQ ID NO: 14601. The piggyBac or piggyBac-like transposon may be transposed by the transposase of SEQ ID NO: 14505, and the transposase may optionally be fused to a nuclear localization signal.

In certain embodiments, the piggyBac or piggyBac-like transposon comprises SEQ ID NO: 14595 and SEQ ID NO: 14596 and the piggyBac or piggyBac-like transposase comprises SEQ ID NO: 14504 or SEQ ID NO: 14505. In certain embodiments, the piggyBac or piggyBac-like transposon comprises SEQ ID NO: 14597 and SEQ ID NO: 14596 and the piggyBac or piggyBac-like transposase comprises SEQ ID NO: 14504 or SEQ ID NO: 14505. In certain embodiments, the piggyBac or piggyBac-like transposon comprises SEQ ID NO: 14595 and SEQ ID NO: 14578 and the piggyBac or piggyBac-like transposase comprises SEQ ID NO: 14504 or SEQ ID NO: 14505. In certain embodiments, the piggyBac or piggyBac-like transposon comprises SEQ ID NO: 14602 and SEQ ID NO: 14600 and the piggyBac or piggyBac-like transposase comprises SEQ ID NO: 14504 or SEQ ID NO: 14505.

In certain embodiments, the piggyBac or piggyBac-like transposon comprises a left end comprising 1, 2, 3, 4, 5, 6, or 7 sequences selected from ATGAGGCAGGGTAT (SEQ ID NO: 14614), ATACCCTGCCTCAT (SEQ ID NO: 14615), GGCAGGGTAT (SEQ ID NO: 14616), ATACCCTGCC (SEQ ID NO: 14617), TAAAATITTA (SEQ ID NO: 14618), ATITUATAAAAT (SEQ ID NO: 14619). TCATACCCTG (SEQ ID NO: 14620) and TAAATAATAATAA (SEQ ID NO: 14621). In certain embodiments, the piggyBac or piggyBac-like transposon comprises a right end comprising 1, 2 or 3 sequences selected from SEQ ID NO: 14617. SEQ ID NO: 14620 and SEQ ID NO: 14621.

In certain embodiments of the methods of the disclosure, the transposase enzyme is a piggyBac or piggyBac-like transposase enzyme. In certain embodiments, the piggyBac or piggyBac-like transposase enzyme is isolated or derived from *Xenopus tropicalis*. The piggyBac or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                                           (SEQ ID NO: 14317)
  1    MAKRFYSAEE AAAHCMASSS EEFSGSDSEY VPPASESDSS TEESWCSSST VSALEEPMEV
 61    DEDVDDLEDQ EAGDRADAAA GGEPAWGPPC NFPPEIPPFT TVPGVKVDTS NEEPINFFQL
121    FMTEAILQDM VLYTNVYAEQ YLTQNPLPRY APAHAWHPTD IAEMKRFVGL TLAMGLIKAN
181    SLESYWDTTT VLSIPVFSAT MSRNRYQLLL RFLHFNNNAT AVPPDQPGHD RLHKLRPLID
241    SLSERFAAVY TPCQNICIDE SLLLFKGRLQ FRQYIPSKRA RYGIKFYKLC ESSSGYTSYF
301    LIYEGKDSKL DPPGCPPPDLT VSGKIVWELI SPLLGQGFHL YVDNFYSSIP LFTALYCLDT
361    PACGTINRNR KGLPRALLDK KLNRGETYAL RKNELLAIKF FDKNNVFMLT SIHDESVIRE
421    QRVGRPPKNK PLCSKEYSKY MGGVDRTDQL QHYYNATRKT RAWYKKVGIY LIQMALRNSY
481    IVYKAAVPGP KLSYYKYQLQ ILPALLFGGV EEQTVPEMPP SDNVARLIGK HFIDTLPPTP
541    GKQRPQKGCK VCRKRGIRRD TRYYCPKCPR NPGLCFKPCF EIYETQLHY.
```

In some embodiments, the piggyBac or piggyBac-like transposase is a hyperactive variant of SEQ ID NO: 14517. In certain embodiments, the piggyBac or piggyBac-like transposase is an integration defective variant of SEQ ID NO: 14517. The piggyBac or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                                           (SEQ ID NO: 14518)
  1    MAKRFYSAEE AAAHCMAPSS EEFSGSDSEY VRPASESDSS TEESWCSSST VSALEEPMEV
 61    DEDVDDLEDQ EAGDRADAAA GGEPAWGPPC NFPPEIPPFT TVPGVKVDTS NFEPINFFQL
121    FMTEAILQDM VLYTNVYAEQ YLTQNPLPRY ARAHAWHPTD IAEMKRFVGL TLAMGLIKAN
181    SLESYWNTTT VLSIPVFSAT MSRNRYQLLL RFLHFNNNAT AVPPDQPDHD RLHKLRPLID
241    SLSERFAAVY TPCQNICIDE SLLLFKGRLR FRQYIPSKRA RYGIKFYKLC ESSSGYTSYF
301    LIYEGKDSKL DPPGCPPPDLT VSGKIVWELI SPLLGQGFHL YVDNFYSSIP LFTALYCLDT
361    PACGTINRTR KGLPRALLDK KLNRGETYAL RKNELLAIKF FDKKNVFMLT SIHDESVIRE
421    QRVGRPPKNK PLCSKEYSKY MGGVDPTDQL QHYYNATRKT SAWYKKVGIY LIQMALRNSY
481    IVYKAAVPGP KLSYYKYQLQ ILPALLFGGV EEQTVPEMLP SDNVARLIGK HFIDTLPPTP
541    GKQRPQKGCK VCRKRGIRRD TRYYCPKCPR NPGLCFKPCF EIYHTQLHY.
```

In certain embodiments, the piggyBac or piggyBac-like transposase is isolated or derived from *Xenopus tropicalis*. In certain embodiments, the piggyBac or piggyBac-like transposase is a hyperactive piggyBac or piggyBac-like transposase. In certain embodiments, the hyperactive piggyBac or piggyBac-like transposase comprises a sequence at least 90% identical to:

```
                                                                (SEQ ID NO: 14572)
  1    MAKRFYSAEE AAAHCSASSS EEFSGSDSEY VPPASESDSS TEESWCSSST VSALEEPMEV

61    DEDVDDLEDQ EAGDRADAAA GGEPAWGPPC NFPPEIPPFT TVPGVKVDTS NFEPINFFQL

121    FMTEAILQDM VLYTNVYAEQ YLTQNPLTRG ARAHAWHPTD IAEMKRFVGL TLAMGLIKAN

181    SIESYWDTTT VLSIPVFGAT MSRNRYQLLL RFLHFNNNAT AVPPDQPGHD RLHKLRPLID

241    SLSERFANVY TPCQNICIDE SLMLFKGRLQ FRQYIPSKRA RYGIKFYKLC ESSTGYTSYF

301    LIYEGKDSKL DPPGCPPDLT VSGKIVWELI SPLLGQGFHL YVDNFYSSIP LFTALYCLNT

361    PACGTINRNR KGLPRALLDK KLNRGETYAL RKNELLAIKF FDKKNVFMLT SIHDESVIRE

421    QRVGRPPKNK PLCSKEYSKY MGGVDPTDQL QHYYNATRKT RHWYKKVGIY LIQMALRNSY

481    IVYKAAYPGP KLSYYKYQLQ ILPALLFGGV EEQTVPEMPD SDNVARLIGK HFIDTLPPTP

541    GKQRPQKGCK VCRKRGIRRD TRYYCPKCPR NPGLCRKPCF EIYHTQLHY.
```

In certain embodiments, piggyBac or piggyBac-like transposase is a hyperactive piggyBac or piggyBac-like transposase. A hyperactive piggyBac or piggyBac-like transposase is a transposase that is more active than the naturally occurring variant from which it is derived. In certain embodiments, a hyperactive piggyBac or piggyBac-like transposase is more active than the transposase of SEQ ID NO: 14517. In certain embodiments, the hyperactive piggyBac or piggyBac-like transposase comprises a sequence of:

```
                                                                (SEQ ID NO: 14572)
  1    MAKRFYSAEE AAAHCSASSS EEFSGSDSEY VPPASESDSS TEESWCSSST VSALEEPMEV

61    DEDVDDLEDQ EAGDRADAAA GGEPAWGPPC NFPPEIPPFT TVPGVKVDTS NFEPINFFQL

121    FMTEAILQDM VLYTNVYAEQ YLTQNPLTRG ARAHAWHPTD IAEMKRFVGL TLAMGLIKAN

181    SIESYWDTTT VLSIPVFGAT MSRNRYQLLL RFLHFNNNAT AVPPDQPGHD RLHKLRPLID

241    SLSERFANVY TPCQNICIDE SLMLFKGRLQ FRQYIPSKRA RYGIKFYKLC ESSTGYTSYF

301    LIYEGKDSKL DPPGCPPDLT VSGKIVWELI SPLLGQGFHL YVDNFYSSIP LFTALYCLNT

361    PACGTINRNR KGLPRALLDK KLNRGETYAL RKNELLAIKF FDKKNVFMLT SIHDESVIRE

421    QRVGRPPKNK PLCSKEYSKY MGGVDPTDQL QHYYNATRKT RHWYKKVGIY LIQMALRNSY

481    IVYKAAYPGP KLSYYKYQLQ ILPALLFGGV EEQTVPEMPD SDNVARLIGK HFIDTLPPTP

541    GKQRPQKGCK VCRKRGIRRD TRYYCPKCPR NPGLCRKPCF EIYHTQLHY.
```

In certain embodiments, the hyperactive piggyBac or piggyBac-like transposase comprises a sequence of:

In certain embodiments, the hyperactive piggyBac or piggyBac-like transposase comprises a sequence of:

```
                                                     (SEQ ID NO: 14624)
  1   MAKRFYSAEE AAAHCMASSS EEFSGSDSEY VPPASESDSS TEESWCSSST VSALEEPMEV
 61   DEDVDDLEDQ EAGDRADAAA GGEPAWGPPC NFPPEIPPFT TVPGVKVDTS NFEPINFFQL
121   FMTEAILQDM VLYTNVYAEQ YLTQNPLTRY ARAHAWHPTD IAEMKRFVGL TLAMGLIKAN
181   SLESYWDTTT VLSIPVESAT MSRNRYQLLL RFLHENNNAT AVPPDQPGHD RLHKLRPLID
241   SLSERFAAVY TPCQNICIDE SLLLFKGRLQ FRQYIPSKRA RYGIKFYKLC ESSSGYTSYF
301   LIYEGKDSKL DPPGCPPDLT VSGKIVWELI SPLLSQGFHL YVDNFYSSIP LFTALYCLNT
361   PACGTINRNR KGLPRALLDK KLNRGETYAL RKNELLAIKF FDKKNVFMLT SIHDESVIRE
421   QRVGRPPKNK PLCSKEYSKY MGGVDRTDQL QHYYNATRKT RHWYKKVGIY LIQMALRNSY
481   IVYKAAVPGP KLSYYKYQLQ ILPALLFGGV EEQTVPEMPP SDNVARLIGK HFIDTLPPTP
541   GKQRPQKGCK VCRKRGIRRD TRYYCPKCPR NPGLCRKPCF EIYHTQLHY.
```

In certain embodiments, the hyperactive piggyBac or piggyBac-like transposase comprises a sequence of:

```
                                                     (SEQ ID NO: 14625)
  1   MAKRFYSAEE AAAHCMASSS EEFSGSDSEY VPPASESDSS TEESVCSSST VSALEEPMEV
 51   DEDVDDLEDQ EAGDRADAAA GGEPAWGPPC NFPPEIPPFT TVPGVKVDTS NFEPINFFQL
121   FMTEAILQDM VLYTNVYAEQ YLTQNPLPRY ARAHAWHPTD IAEMKRFVGL TLAMGLIKAN
181   SLESYWDTTT VLKIPVFSAT MSRNRYQLLL RFLHFNNNAT AVPPDQPGHD RLHKLRPLID
241   SLSERFAAVY TPCQNICIDE SLLIFKGRLQ FRQYIPSKRA RYGIKFYKLC ESSSGYTSYF
301   LIYEGKDSKL DPPGCPPDLT VSGKIVWELI SPLLGQGFHL YVDNFYSSIP LFTALYCLNT
351   PACGTINRNR KGLPRALLDK KLNRGETYAL RKNELLAIKF FDKKNVFMLT SIHDESVIRE
421   QRVGRPPKNK PLCSKEYSKY MGGVDRTDQL QHYYNATRKT RHWYKKVGIY LIQMALRNSY
481   IVYKAAVPGP KLSYYKYQLQ ILPALLFGGV EEQTVPEMPP SDNVARLIGK HFIDTLPPTP
541   GKQRPQKGCK VCRKRGIRRD TRYYCPKCPR NPGLCFKPCF EIYHTQLHY.
```

In certain embodiments, the hyperactive piggyBac or piggyBac-like transposase comprises a sequence of:

```
                                                     (SEQ ID NO: 14627)
  1   MAKRFYSAEE AAAHCMASSS EQTSGSDSEY VPPASESDSS TEESWCSSST VSALEEPMEV
 61   DEDVDDLEDQ EAGDRADAAA GGEPAWGPPC NFPPEIPPFT TVPCVKVDTS NFEPINFFQL
121   FMTEAILQDM VLYTNVYAEQ YLTQNPLTRY ARAHAWHPTD IAEMKRFVGL TLAMGLIKAN
181   SIESYWDTTT VLSIPVFGAT MSRNRYQLLL RFLHFNNNAT AVPPDQPGHD RLHKLRPLID
241   SLSERFANVY TPCQNICIDE SLLLFKGRLQ FRQYIPSKRA RYGIKFYKLC ESSSGYTSYF
301   LIYEGKDSKL DPPGCPPDLT VSGKIVWELI SPLLGQGFHL YVDNFYSSIP LFTALYCLNT
361   PACGTINRNR KGLPRALLDK KLNRGETYAL RKNELLAIKF FDKKNVFMLT SIHDESVIRE
421   QRVGRKPKNK PLCSKEYSKY MGGVDRTDQL QHYYNATRKT RHWYKKVGIY LIQMALRNSY
481   IVYKAAVPGP KLSYYKYQLQ ILPALLFGGV EEQTVPEMPP SDNVARLIGK HFIDTLPPTP
541   GKQRPQKGCK VCRKRGIRRD TRYYCPKCPR NPGLCRKPCF EIYHTQLHY.
```

In certain embodiments, the hyperactive piggyBac or piggyBac-like transposase comprises a sequence of:

```
                                                      (SEQ ID NO: 14628)
  1  MAKRFYSAEE AAAHCSASSS EEFSGSDSEY VPPASESDSS TEESWCSSST VSALEEPMEV

61  DEDVDDLEDQ EAGDRADAAA GGEPAWGPPC NFPPEIPPFT TVPGVKVDTS NFEPINFFQL

121  FMTEAILQDM VLYTNVYAEQ YLTQNPLTRG ARAHAWHPTD IAEMKRFVGL TLAMGLIKAN

181  SLESYWDTTT VLSIPVFGAT MSRNRYQLLL RFLHFNNNAT AVPPDQPGHD RLHKLRPLID

241  SLSERFANVY TPCQNICIDE SLMLFKGRLQ FRQYIPSKRA RYGIKFYKLC ESSTGYTSYF

301  LIYEGKDSKL DPPGCPPDLT VSGKIVWELI SPLLGQGFHL YVDNFYSSIP LFTALYCLNT

361  PACGTINRNR KGLPRALLDK KLNRGETYAL RKNELLAIKF FDKKNVFMLT SIHDESVIRE

421  QRVGRPPKNK PLCSKEYSKY MGGVDRTDQL QHYYNATRKT RHWYKKVGIY LIQMALRNSY

481  IVYKAAVPGP KLSYYKYQLQ ILPALLFGGV EEQTVPEMPP SDNVARLIGK HFIDTLPPTP

541  GKQRPQKGCK VCRKRGIRRD TRYYCPKCPR NPGLCRKPCF EIYHTQLHY.
```

In certain embodiments, the hyperactive piggyBac or piggyBac-like transposase comprises a sequence of: (SEQ ID NO: 17042).

In certain embodiments, the hyperactive piggyBac or piggyBac-like transposase comprises an amino acid substitution at a position selected from amino acid 6, 7, 16, 19, 20, 21, 22, 23, 24, 26, 28, 31, 34, 67, 73, 76, 77, 88, 91, 141, 145, 146, 148, 150, 157, 162, 179, 182, 189, 192, 193, 196, 198, 200, 210, 212, 218, 248, 263, 270, 294, 297, 308, 310, 333, 336, 354, 357, 358, 359, 377, 423, 426, 428, 438, 447, 450, 462, 469, 472, 498, 502, 517, 520, 523, 533, 534, 576, 577, 582, 583 or 587 (relative to SEQ ID NO: 14517). In certain embodiments, the hyperactive piggyBac or piggyBac-like transposase comprises an amino acid substitution of Y6C, S7G, M16S, S19G, S20Q, S20G, S20D, E21D, E22Q, F23T, F23P, S24Y, S26V, S28Q, V31K, A34E, L67A, G73H, A76V, D77N, P88A, N91D, Y141Q, Y141A, N145E, N145V, P146T, P146V, P146K, P148T, P148H, Y150G, Y150S, Y50C, H157Y, A162C, A179K, L182I, L182V, T189G, L192H, S193N, S193K, V1%, S198G, T200W, L210H, F212N, N218E, A248N, L263M, Q270L, S294T, T297M, S308R, L310R, L333M, Q336M, A354H, C357V, L358F, D359N, L3771, V423H, P426K, K428R, S438A, T447G, T447A, L450V, A462H, A462Q, I469V, I472L, Q498M, L502V, E5171, P520D, P520G, N523S, I533E, D534A, F576R, F576E, K577I, I582R, Y583F, L587Y or L587W, or any combination thereof including at least 1, 2, 3, 4, 5, 6, 7, 8, 9, 10 or all of these mutations (relative to SEQ ID NO: 14517).

In certain embodiments, the hyperactive piggyBac or piggyBac-like transposase comprises one or more substitutions of an amino acid that is not wild type, wherein the one or more substitutions a for wild type amino acid comprises a substitution of A2X, K3X, R4X, F5X, Y6X, S7X, A11X, A3X, C15X, M16X, A17X, S18X, S19X, S20X, E21X, E22X, F23X, S24X, G25X, 26X, D27X, S28X, E29X, E42X, E43X, S44X, C46X, S47X, S48X, S49X, T50X, V51X, S52X, A53X, L54X, E55X, E56X, P57X, M58X, E59X, E62X, D63X, V64X, D65X, D66X, L67X, E68X, D69X, Q70X, E71X, A72X, G73X, D74X, R75X, A76X, D77X, A78X, A79X, A80X, G81X, G82X, E83X, P84X, A85X, W86X, G87X, P88X, P89X, C90X, N91X, F92X, P93X, E95X, I96X, P97X, P98X, F99X, T100X, T101X, P103X, G104X, V105X, K106X, V107X, D108X, T109X, N111 X, P114X, I115X, N116X, F117X, F118X, Q119X, M122X, T123X, E124X, A125X, I126X, L127X, Q128X, D129X, M130X, L132X, Y133X, V126X, Y127X, A138X, E139X, Q140X, Y141X, L142X, Q144X, N145X, P146X, L147X, P148X, Y150X, A151X, A155X, H157X, P158X, I161X, A162X, V168X, T171X, L72X, A173X, M174X, I177X, A179X, L182X, D187X, T188X, T189X, T190X, L192X, S193X, I194X, P195X, V196X, S198X, A199X, T200X, S202X, L208X, L209X, L210X, R21 X, F212X, F215X, N217X, N218X, A219X, T220X, A221X, V222X, P224X, D225X, Q226X, P227X, H229X, R231X, H233X, L235X, P237X, I239X, D240X, L242X, S243X, E244X, R244X, F246X, A247X, A248X, V249X, Y250X, T251X, P252X, C253X, Q254X, I256X, C257X, I258X, D259X, E260X, S261X, L262X, L263X, L264X, F265X, K266X, G267X, R268X, L269X, Q270X, F271X, R272X, Q273X, Y274X, I275X, P276X, S277X, K278X, R279X, A280X, R281X, Y282X, G283X, I284X, K285X, F286X, Y287X, K288X, L289X, C290X, E291X, S292X, S293X S294X, G295X, Y296X, T297X, S298X, Y299X, F300X, E304X, L310X, P313X, G314X, P316X, P317X, D318X, L319X, T320X, V321X, K324X, E328X, I330X, S331X, P332X, L333X, L334X, G335X, Q336X, F338X, L340X, D343X, N344X, F345X, Y346X, S347X, L351X, F352X, A354X, L355X, Y356X, C357X, L358X, D359X, T360X, R422X, Y423X, G424X, P426X, K428X, N429X, K430X, P431X, L432X, S434X, K435X, E436X, S438X, K439X, Y440X, G443X, R446X, T447X, L450X, Q451X, N455X, T460X, R461X, A462X, K465X, V467X, G468X, I469X, Y470X, L471X, I472X, M474X, A475X, L476X, R477X, S479X, Y480X, V482X Y483X, K484X, A485X, A486X, V487X, P488X, P490X, K491X, S493X, Y494X, Y495X, K496X, Y497T, Q498X, L499X, Q500X, I501X, L502X, P503X, A504X, L505X, L506X, F507X, G508X, G509X, V510X, E511X, E512X, Q513X, T514X, V515X, E517X, M518X, P519X, P520X, S521X, D522X, N523X, V524X, A525X, L527X, I528X, K530X, H531X, F532X, I533X, D534X, T535X, L536X, T539X, P540X, Q546X, K550X, R553X, K554X, R555X, G556X, I557X, R558X, R559X, D560X, T561X, Y564X, P566X, K567X, P569X, R570X, N571X, L574X, C575X, F576X, K577X, P578X, F580X, E581X, I582X, Y583X, T585X, Q586X, L587X, H588X or Y589X (relative to SEQ ID NO: 14517). A list of hyperactive amino acid substitutions can be found in U.S. Pat. No. 10,041,077, the contents of which are incorporated by reference in their entirety.

In certain embodiments, the piggyBac or piggyBac-like transposase is integration deficient. In certain embodiments, an integration deficient piggyBac or piggyBac-like transposase is a transposase that can excise its corresponding transposon, but that integrates the excised transposon at a lower frequency than a corresponding naturally occurring transposase. In certain embodiments, the piggyBac or piggyBac-like transposase is an integration deficient variant of SEQ ID NO: 14517. In certain embodiments, the integration deficient piggyBac or piggyBac-like transposase is deficient relative to SEQ ID NO: 14517.

In certain embodiments, the piggyBac or piggyBac-like transposase is active for excision but deficient in integration. In certain embodiments, the integration deficient piggyBac or piggyBac-like transposase comprises a sequence that is at least 90% identical to a sequence of:

(SEQ ID NO: 14605)
```
  1   MAKRFYSAEE AAAHCMASSS EEFSGSDSEY VPPASESDSS TEESWCSSST VSALEEPMEV
 61   DEDVDDLEDQ EAGDRVDAAA GGEPAWGPPC NFPPEIPPFT TVPGVKVDTS NFEPINFFQL
121   FMTEAILQDM VLYTNVYAEQ YLTQNPLPRY ARAHAWHPTD IAEMKRFVGL TLAMGLIKAN
181   SLESYWDTTT VLSIPVFSAT MSRNRYQLLL KFLHFNNEAT AVPPDQPGHD RLHKLRPLID
241   SLSERFAAVY TPCQNICIDE SLLLFKGRLQ FRQYIPSKRA RYGIKFYKLC ESSSGYTSYF
301   LIYEGKDSKL DPPGCPPDLT VSGKIVWELI SPLLGQGFHL YVDNFYSSIP LFTALYCLDT
361   PACGTINRNR KGLPRALLDK KLNRGETYAL RKNELLAIKF FDKKNVFMLT SIHDESVIRE
421   QRVGRPPKNK PLCSKEYSKY MGGVDRTDQL QHYYNATRKT RAWYKKVGIY LIQMALRNSY
481   IVYKAAVPGP KLSYYKYQLQ ILPALLFGGV EEQTVPEMPP SDNVARLIGK HFIDTLPPTP
541   GKQRPQKGCK VCRKRGIRRD TRYYCPKCPR NPGLCFKPCF EIYHTQLHYG RR.
```

In certain embodiments, the integration deficient piggyBac or piggyBac-like transposase comprises a sequence that is at least 90% identical to a sequence of:

(SEQ ID NO: 14604)
```
  1   MAKRFYSAEE AAAHCMASSS EEFSGSDSEY VPPASESDSS TEESWCSSST VSALEEPMEV
 61   DEDVDDLEDQ EAGDRADAAA GGEPAWGPPC NFPPEIPPFT TVPGVKVDTS NFEPINFFQL
121   FMTEAILQDM VLYTNVYAEQ YLTQVPLPRY ARAHAWHPTD IAEMKRFVGL TLAMGLIKAN
181   SLESYWDTTT VLNIPVFSAT MSRNRYQLLL RFLEFNNEAT AVPPDQPGHD RLHKLRPLID
241   SLSERFAAVY TPCQNICIDE SLLLFKGRLQ FRQYIPSKRA RYGIKFYKLC ESSSGYTSYF
301   LIYEGKDSKL DPPGCPPDLT VSGKIVWELI SPLLGQGFHL YVDNFYSSIP LFTALYCLDT
361   PACGTINRNR KGLPRALLDK KLNRGETYAL RKNELLAIKF FDKKNVFMLT SIHDESVIRE
421   QPVGRPPKNK PLCSKEYSKY MGGVDRTDQL QHYYNATRKT RAWYKKVGIY LIQMALRNSY
481   IVYKAAVPGP KLSYYKYQLQ ILPALLFGGV EEQTVPEMPP SDNVARLIGK HFIDTLPPTP
541   GKQRPQKGCK VCRKRGIRRD TRYYCPKCPR NPGLCFKPCF EIYHTQLHY.
```

In certain embodiments, the integration deficient piggyBac or piggyBac-like transposase comprises a sequence that is at least 90% identical to a sequence of:

(SEQ ID NO: 14611)
```
  1   MAKRFYSAEE AAAHCMASSS EEFSGSDSEY VPPASESDSS TEESWCSSST VSALEEPMEV
 61   DEDVDDLEDQ EAGDRADAAA GGEPAWGPPC NFPPEIPPFT TVPGVKVDTS NFEPINFFQL
121   FMTEAILQDM VLYTNVYAEQ YLTQNVLPRY ARAHAWHPTD IAEMKRFVGL TLAMGLIKAN
181   SLESYWDTTT VLSIPVFSAT MSRNRYQLLL RFLHFNNDAT AVPPDQPGHD RLHKLRPLID
241   SLTERFAAVY TPCQNICIDE SLLLFKGRLQ FRQYIPSKRA RYGIKFYKLC ESSSGYTSYF
301   LIYEGKDSKL DPPGCPPDLT VSGKIVWELI SPLLGQGFHL YVDNFYSSIP LFTALYCLDT
361   PACGTINRNR KGLPRALLDK KLNRGETYAL RKNELLAIKF FDKKNVFMLT SIHDESVIRE
421   QRVGRPPKNK PLCSKEYSKY MGGVDRTDQL QHYYNATRKT RAWYKKVGIY LIQMALRNSY
```

```
481   IVYKAAYPGP KLSYYKYQLQ ILPALLFGGV EEQTVPEMPP SDNVARLIGK HFIDTLPPTP

541   GKQRPQKGCK VCRKRGIRRD TRYYCPKCPR NPGLCFKPCF EIYHTQLHYG RR.
```

In certain embodiments, the integration deficient piggyBac or piggyBac-like transposase comprises SEQ ID NO: 14611. In certain embodiments, the integration deficient piggyBac or piggyBac-like transposase comprises a sequence that is at least 90% identical to a sequence of:

```
                                                     (SEQ ID NO: 14612)
  1   MAKRFYSAEE ALAHCMASSS EEFSGSDSEY VPPASESDSS TEESWCSSST VSALEEPMEV

61   DEDVDDLEDQ EAGDRADAAP GGEPAWGPPC NFPPEIPPFT TVPGVKVDTS NFEPINFFQL

121   FMTEAILQDM VLYTNVYAEQ YLTQVPLPRY ARAHAWHPTD IAEMKRFVGL TLAMGLIKAN

181   SLESYWDTTT VLSIPVFSAT MSRNRYQLLL RFLHFNNEAT AVPPDQPGHD RLHKLRPLID

241   SLSERFAAVY TPCQNICIDE SLLLFKGRLQ FRQYIPSKRA RYGIYFYKLC ESSSGYTSYF

301   LIYEGKDSKL DPPGCPDDLT VSGKIVWELI SPLLGQGFHL YVDNFYSSIP LFTALYCLDT

361   PACGTINRNR KGLPRALLDK KLNRGETYAL RKNELLAIKF FDKKNVFMLT SIHDESVIRE

421   QRVGRPPKNK PLCSKEYSKY MGGVDRTDQL QHYYNATRKT RAWYKKVGIY LIQMALRNSY

481   IVYKAAVPGP KLSYYKYQLQ ILPALLFGGV EEQTVPEMPP SDNVARLIGK HFIDTLPPTP

541   GKQRPQKGCK VCRKRGIRRD TRYYCPKCPR NPGLCFKPCF EIYHTQLHYG RR.
```

In certain embodiments, the integration deficient piggyBac or piggyBac-like transposase comprises SEQ ID NO: 14612. In certain embodiments, the integration deficient piggyBac or piggyBac-like transposase comprises a sequence that is at least 90% identical to a sequence of

```
                                                     (SEQ ID NO: 14613)
  1   MAKRFYSAEE AAAHCMASSS EEFSGSDSEY VPPASESDSS TEESWCSSST VSALEEPMEV

61   DEDVDDLEDQ EAGDRADAAA GGEPAWGPPC NFPPEIPPFT TVPGVKVDTS NFEPINFFQL

121   FMTEAILQDM VLYTNVYAEQ YLTQVPLPRY ARAHAWHPTD IAEMKRFVGL TLAMGLIKAN

181   SLESYWDTTT VLNIPVFSAT MSRNRYQLLL RFLEFNNNAT AVPPDQPGHD RLHKLRPLID

241   SLSERFAAVY TPCQNICIDE SLLLFKGRLQ FRQYIPSKRA RYGIKFYKLC ESSSGYTSYF

301   LIYEGKDSKL DPPGCPPDLT VSGKIVWELI SPLLGQGFHL YVDNEYSSIP LFTALYCLDT

361   PACGTINRNR KGLPRALLDK KLNRGETYAL RKNELLAIKF FDKKNVFMLT SIHDESVIRE

421   QRVGRPPKNK PLCSKEYSKY MGGVDRTDQL QHYYNATRKT RAWYKKVGIY LIQMALRNSY

481   IVYKAAVPGP KLSYYKYQLQ ILPALLFGGV EEQTVPEMPP SDNVARLIGK HFIDTLPPTP

541   GKQRPQKGCK VCRKRGIRRD TRYYCPKCPR NPGLCFKPCF EIYHTQLHYG RR.
```

In certain embodiments, the integration deficient piggyBac or piggyBac-like transposase comprises SEQ ID NO: 14613. In certain embodiments, the integration deficient piggyBac or piggyBac-like transposase comprises an amino acid substitution wherein the Asn at position 218 is replaced by a Glu or an Asp (N218D or N218E) (relative to SEQ ID NO: 14517).

In certain embodiments, the excision competent, integration deficient piggyBac or piggyBac-like transposase comprises one or more substitutions of an amino acid that is not wild type, wherein the one or more substitutions a for wild type amino acid comprises a substitution of A2X, K3X, R4X, F5X, Y6X, S7X, A8X, E9X, E10X, A11X, A12X, A13X, H14X, C15X, M16X, A17X, S18X, S19X, S20X, E21X, E22X, F23X, S24X, G25X, 26X, D27X, S28X, E29X, V31X, P32X, P33X, A34X, S35X, E36X, S37X, D38X, S39X, S40X, T41X, E42X, E43X, S44X, W45X, C46X, S47X, S48X, S49X, T50X, V51X, S52X, A53X, L54X, E55X, E56X, P57X, M58X, E59X, V60X, M122X, T123X, E124X, A125X, L127X, Q128X, D129X, L132X, Y133X, V126X, Y127X, E139X, Q140X, Y141X, L142X, T43X, Q144X, N145X, P146X, L147X, P148X, R149X, Y150X, A151X, H154X, H157X, P158X, T159X, D160X, I161X, A162X, E163X, M164X, K165X, R166X, F167X, V168X, G169X, L170X, T171X, L172X, A173X, M174X, G175X, L176X, I177X, K178X, A179X, N180X, S181X, L182X, S184X, Y185X, D187X, T188X, T89X, T190X, V191X, L192X, S193X, 1194X, P195X, V196X, F197X, S198X, A199X, T200X, M201X, S202X, R203X, N204X, R205X, Y206X, Q207X, L208X, L209X, L210X, R211X, F212X, L213X, H241X, F215X, N216X, N217X, N218X, A219X, T220X, A221X, V222X, P223X, P224X, D225X, Q226X, P227X, G228X, H229X, D230X, R231X, H233X, K234X, L235X, R236X, L238X, I239X, D240X, L242X, S243X, E244X, R244X, F246X, A247X, A248X, V249X, Y250X, T251X, P252X, C253X, Q254X, N255X, I256X, C257X, I258X, D259X, E260X, S261X, L262X, L263X, L264X, F265X, K266X, G267X, R268X, L269X, Q270X, F271X, R272X, Q273X, Y274X, I275X, P276X, S277X, K278X, R279X, A280X, R281X, Y282X, G283X, I284X, K285X, F286X, Y287X, K288X, L289X, C290X, E291X, S292X, S293X, S294X, G295X, Y296X, T297X, S298X, Y299X, F300X, I302X, E304X, G305X, K306X, D307X, S308X, K309X, L310X, D311X, P312X, P313X, G314X, C315X, P316X, P317X, D318X, L319X, T320X, V321X, S322X, G323X, K324X, I325X, V326X, W327X, E328X, L329X, I330X, S331X, P332X, L333X, L334X, G335X, Q336X, F338X, H339X, L340X, V342X, N344X, F345X, Y346X, S347X, S348X, I349X, L351X, T353X, A354X, Y356X, C357X, L358X, D359X, T360X, P361X, A362X, C363X, G364X, I366X, N367X, R368X, D369X, K371X, G372X, L373X, R375X, A376X, L377X, L378X, D379X, K380X, K381X, L382X, N383X, R384X G385X, T387X, Y388X, A389X, L390X, K392X, N393X, E394X, A397X, K399X, F400X, F401X, D402X, N405X, L406X, L409X, R422X, Y423X, G424X, E425X, P426X, K428X, N429X, K430X, P431X, L432X, S434X, K435X, E436X, S438X, K439X, Y440X, G442X, G443X, V444X, R446X, T447X, L450X, Q451X, H452X, N455X, T457X, R458X, T460X, R461X, A462X, Y464X, K465X, V467X, G468X, I469X, L471X, I472X, Q473X, M474X, L476X, R477X, N478X, S479X, Y480X, V482XY483X, K484X, A485X, A486X, V487X, P488X, G489X, P490X, K491X, L492X, S493X, Y494X, Y495X, K496X, Q498X, L499X, Q500X, I501X, L502X, P503X, A504X, L505X, L506X, F507X, G508X, G509X, V510X, E511X, E512X, Q513X, T514X, V515X, E517X, M518X, P519X, P520X, S521X, D522X, N523X, V524X, A525X, L527X, I528X, G529X, K530X, F532X, I533X, D534X, T535X, L536X, P537X, P538X, T539X, P540X, G541X, F542X, Q543X, R544X, P545X, Q546X, K547X, G548X, C549X, K550X, V551 X, C552X, R553X, K554X, R555X, G556X, I557X, R558X, R559X, D560X, T561X, R562X, Y563X, Y564X, C565X, P566X, K567X, C568X, P569X, R570X, N571X, P572X, G573X, L574X, C575X, F576X, K577X, P578X, C579X, F580X, E581X, I582X, Y583X, H584X, T585X, Q586X, L587X, H588X or Y589X (relative to SEQ ID NO: 14517). A list of excision competent, integration deficient amino acid substitutions can be found in U.S. Pat. No. 10,041,077, the contents of which are incorporated by reference in their entirety.

In certain embodiments, the piggyBac or piggyBac-like transposase is fused to a nuclear localization signal. In certain embodiments, SEQ ID NO: 14517 or SEQ ID NO: 14518 is fused to a nuclear localization signal. In certain embodiments, the amino acid sequence of the piggyBac or piggyBac like transposase fused to a nuclear localization signal is encoded by a polynucleotide sequence comprising:

```
                                                           (SEQ ID NO: 14626)
   1   atggcaccca aaaagaaacg taaagtgatg gccaaaagat tcacagcgc cgaagaagca 61   gcagcacatt gcatggcatc gtcatccgaa gaattctcgg ggagcgattc cgaatatgtc 121   ccaccggcct cggaaagcga ttcgagcact gaggagtcgt ggcgttcctc ctcaactgtc 181   tcggctcttg aggagccgac ggaagtggat gaggatgtgg acgacttgga ggaccaggaa 241   gccggagaca gggccgacgc tgccgcggga ggggagccgg cgcggggacc tccatgcaat 301   tttcctcccg aaatcccacc gttcactact gtgccgggag tgaaggtcga cacgtccaac 361   ttcgaaccga tcaatttctc tcaactcttc atgactgaag cgatcctgca agatatggtg 421   ctctacacta atgtgtacgc cgagcagtac ctgactcaaa acccgctgcc tcgctacgcg 481   agagcgcatg cgtggcaccc gaccgatatc gcggagatga agcggttcgt gggactgacc 541   ctcgcaatgg gcctgatcaa ggccaacagc ctcgagtcat accgggatac cacgactgtg 601   cttagcattc cggtgttctc cgctaccatg tcccgtaacc gccaccaact cctgctgcgg 661   ttcctccact caacaacaa tgcgaccgct gtgccacctg accagccagg acacgacaga 721   ctccacaagc tgcggccatc gatcgactcg ctgagcgagc gactcgccgc ggtgtacacc 781   ccttgccaaa acatttgcaa cgacgagtcg cttctgctgt ttaaaggccg gcttcagttc 841   cgccagtaca tcccatcgaa gcgcgctcgc tatggtatca aattctacaa actctgcgag 901   tcgtccagcg gctacacgtc atacttcttg atctacgagg ggaaggactc taagctggac 951   ccaccggggt gtccaccgga tcttactgtc tccggaaaaa tcgtgtggga actcatctca 1021   cctctcctcg acaaggctc tcatctctac gtcgacaatt tccactcatc gatccctctg 1081   ttcaccgccc tctactgccc ggatactcca gcctgtggga ccattaacag aaaccggaag 1141   ggtctgccga gagcactgcc ggataagaag ttgaacaggg gagagactta cgcgctgaga 1201   aagaacgaac tcctcgccat caaattcttc gacaagaaaa atgtgtttat gctccacctcc 1321   ctgtgctcta aggaatactc caagtacatg gggggtgtcg accggaccga tcagctgcag 1381   cattactaca acgccactag aaagacccgg gcctggtaca agaaagtcgg catctacctg 1441   atccaaatgg cactgaggaa ttcgtatatt gtctacaagg ctgccgttcc gggcccgaaa
```

```
1501  ctgtcatact acaagtacca gcttcaaatc ctgccggcgc tgctgttcgg tggagtggaa 1561  gaacagactg tgcccgagat gccgccatcc gacaacgtgg cccggttgat cggaaagcac 1621  ttcattgata ccctgcctcc gacgcctgga aagcagcggc cacagaaggg atgcaaagtt 1681  tgccgcaagc gcggaatacg gcgcgatacc cgctactatt gcccgaagtg cccccgcaat 1741  cccggactgt gtttcaagcc ctgttttgaa atctaccaca cccagttgca ttac.
```

In certain embodiments, the piggyBac or piggyBac-like transposon is isolated or derived from *Xenopus tropicalis*. In certain embodiments, the piggyBac or piggyBac-like transposon comprises a sequence of:

```
                                                          (SEQ ID NO: 14519)
  1   ttaaccttt tactgccaat gacgcatggg atacgtcgtg gcagtaaaag ggcttaaatg 61   ccaacgacgc gtcccatacg ttgttggcat tttaagtctt ctatctgcag cggcagcatg 121   tgccgccgct gcagagagtt tctagcgatg acagcccctc tgggcaacga gccgggggggg 181   ctgt.
```

In certain embodiments, the piggyBac or piggyBac-like transposon comprises a sequence of:

```
                                                          (SEQ ID NO: 14520)
  1   tttgcatttt tagacattta gaagcctata tcttgttaca gaattggaat tacacaaaaa 61   ttctaccata ttttgaaagc ttaggttgtt ctgaaaaaaa caatatattg ttttcctggg 121   taaactaaaa gtcccctcga ggaaaggccc ctaaagtgaa acagtgcaaa acgttcaaaa 181   actgtctggc aatacaagtt ccactttgac caaaacggct ggcagtaaaa gggttaa.
```

In certain embodiments, the piggyBac or piggyBac-like transposon comprises SEQ ID NO: 14519 and SEQ ID NO: 14520. In certain embodiments, the piggyBac or piggyBac-like transposon comprises a sequence of:

```
                                                          (SEQ ID NO: 14521)
  1   ttaacccttt gcctgccaat cacgcatggg atacgtcgtg gcagtaaaag ggcttaaatg 61   ccaacgacgc gtcccatacg ttgttggcat tttaagtctt ctctctgcag cggcagcatg 121   tgccgccgct gcagagagtt tctagcgatg acagcccctc tgggcaacga gccgggggggg 181   ctgtc.
```

In certain embodiments, the piggyBac or piggyBac-like transposon comprises a sequence of:

```
                                                          (SEQ ID NO: 14522)
  1   tttgcatttt tagacattta gaagcctata tcttgttaca gaattggaat tacacaaaaa 61   ttctaccata ttttgaaagc ttaggttgtt ctgaaaaaaa caatatattg ttttcctggg 121   taaactaaaa gtcccctcga ggaaaggccc ctaaagtgaa acagtgcaaa acgttcaaaa 181   actgtctggc aatacaagtt ccactttggg acaaatcggc tggcagtgaa agggttaa.
```

In certain embodiments, the piggyBac or piggyBac-like transposon comprises a sequence of:

```
                                                          (SEQ ID NO: 14523)
  1  ttaacctttt tactgccaat gacgcatggg atacgtcgtg gcagtaaaag ggcttaaatg 61  ccaacgacgc gtcccatacg ttgttggcat tttaattctt ctctctgcag cggcagcatg 121  tgccgccgct gcagagagtt tctagcgatg acagccctc tgggcaacga gccgggggg 181  ctgtc.
```

In certain embodiments, the piggyBac or piggyBac-like transposon comprises SEQ ID NO: 14520 and SEQ ID NO: 14519, SEQ ID NO: 14521 or SEQ ID NO: 14523. In certain embodiments, the piggyBac or piggyBac-like transposon comprises SEQ ID NO: 14522 and SEQ ID NO: 14519, SEQ ID NO: 14521 or SEQ ID NO: 14523. In certain embodiments, the piggyBac or piggyBac-like transposon comprises one end comprising at least 14, 16, 18, 20, 30 or 40 contiguous nucleotides from SEQ ID NO: 14519, SEQ ID NO: 14521 or SEQ ID NO: 14523. In certain embodiments, the piggyBac or piggyBac-like transposon comprises one end comprising at least 14, 16, 18, 20, 30 or 40 contiguous nucleotides from SEQ ID NO: 14520 or SEQ ID NO: 14522. In certain embodiments, the piggyBac or piggyBac-like transposon comprises one end with at least 90% identity to SEQ ID NO: 14519, SEQ ID NO: 14521 or SEQ ID NO: 14523. In certain embodiments, the piggyBac or piggyBac-like transposon comprises one end with at least 90% identity to SEQ ID NO: 14520 or SEQ ID NO: 14522. In one embodiment, one transposon end is at least 90% identical to SEQ ID NO: 14519 and the other transposon end is at least 90% identical to SEQ ID NO: 14520.

In certain embodiments, the piggyBac or piggyBac-like transposon comprises a sequence of TTAACCTTTT-TACTGCCA (SEQ ID NO: 14524). In certain embodiments, the piggyBac or piggyBac-like transposon comprises a sequence of TTAACCCTTTGCCTGCCA (SEQ ID NO: 14526). In certain embodiments, the piggyBac or piggyBac-like transposon comprises a sequence of TTAACCYTTT-TACTGCCA (SEQ ID NO: 14527). In certain embodiments, the piggyBac or piggyBac-like transposon comprises a sequence of TGGCAGTAAAAGGGTTAA (SEQ ID NO: 14529). In certain embodiments, the piggyBac or piggyBac-like transposon comprises a sequence of TGGCAGT-GAAAGGGTTAA (SEQ ID NO: 14531). In certain embodiments, the piggyBac or piggyBac-like transposon comprises a sequence of TTAACCYTITKMCTGCCA (SEQ ID NO: 14533). In certain embodiments, one end of the piggyBac or piggyBac-like transposon comprises a sequence selected from SEQ ID NO: 14524, SEQ ID NO: 14526 and SEQ ID NO: 14527. In certain embodiments, one end of the piggyBac™ (PB) or piggyBac-like transposon comprises a sequence selected from SEQ ID NO: 14529 and SEQ ID NO: 14531. In certain embodiments, each inverted terminal repeat of the piggyBac or piggyBac-like transposon comprises a sequence of ITR sequence of CCYTTTKMCTGCCA (SEQ ID NO: 14563). In certain embodiments, each end of the piggyBac™ (PB) or piggyBac-like transposon comprises SEQ ID NO: 14563 in inverted orientations. In certain embodiments, one ITR of the piggyBac or piggyBac-like transposon comprises a sequence selected from SEQ ID NO: 14524, SEQ ID NO: 14526 and SEQ ID NO: 14527. In certain embodiments, one ITR of the piggyBac or piggyBac-like transposon comprises a sequence selected from SEQ ID NO: 14529 and SEQ ID NO: 14531. In certain embodiments, the piggyBac or pig-gyBac like transposon comprises SEQ ID NO: 14533 in inverted orientation in the two transposon ends.

In certain embodiments. The piggyBac or piggyBac-like transposon may have ends comprising SEQ ID NO: 14519 and SEQ ID NO: 14520 or a variant of either or both of these having at least 90% sequence identity to SEQ ID NO: 14519 or SEQ ID NO: 14520, and the piggyBac or piggyBac-like transposase has the sequence of SEQ ID NO: 14517 or a variant showing at least %, 10%, 15%, 20%, 25%, 30%, 35%, 40%, 45%, 50%, 55%, 60%, 65%, 70%, 75%, 80%, 85%, 90%, 95%, 99% or any percentage in between sequence identity to SEQ ID NO: 14517 or SEQ ID NO: 14518. In certain embodiments, one piggyBac or piggyBac-like transposon end comprises at least 14 contiguous nucleotides from SEQ ID NO: 14519, SEQ ID NO: 14521 or SEQ ID NO: 14523, and the other transposon end comprises at least 14 contiguous nucleotides from SEQ ID NO: 14520 or SEQ ID NO: 14522 In certain embodiments, one transposon end comprises at least 15, at least 16, at least 17, at least 18, at least 19, at least 20, at least 22, at least 25, at least 30 contiguous nucleotides from SEQ ID NO: 14519, SEQ ID NO: 14521 or SEQ ID NO: 14523, and the other transposon end comprises at least 15, at least 16, at least 17, at least 18, at least 19, at least 20, at least 22, at least 25 or at least 30 contiguous nucleotides from SEQ ID NO: 14520 or SEQ ID NO: 14522.

In certain embodiments, the piggyBac or piggyBac-like transposase recognizes a transposon end with a left sequence corresponding to SEQ ID NO: 14519, and a right sequence corresponding to SEQ ID NO: 14520. It will excise the transposon from one DNA molecule by cutting the DNA at the 5'-TTAA-3' sequence at the left end of one transposon end to the 5'-TTAA-3' at the right end of the second transposon end, including any heterologous DNA that is placed between them, and insert the excised sequence into a second DNA molecule. In certain embodiments, truncated and modified versions of the left and right transposon ends will also function as part of a transposon that can be transposed by the piggyBac or piggyBac-like transposase. For example, the left transposon end can be replaced by a sequence corresponding to SEQ ID NO: 14521 or SEQ ID NO: 14523, the right transposon end can be replaced by a shorter sequence corresponding to SEQ ID NO: 14522. In certain embodiments, the left and right transposon ends share an 18 bp almost perfectly repeated sequence at their ends (5'-TTAACCYTITKMCTGCCA: SEQ ID NO: 14533) that includes the 5'-TTAA-3' insertion site, which sequence is inverted in the orientation in the two ends. That is in SEQ ID NO: 14519 and SEQ ID NO: 14523 the left transposon end begins with the sequence 5'-TTAACCTTTT-TACTGCCA-3' (SEQ ID NO: 14524), or in SEQ ID NO: 14521 the left transposon end begins with the sequence 5'-TTAACCCTTTGCCTGCCA-3' (SEQ ID NO: 14526); the right transposon ends with approximately the reverse complement of this sequence: in SEQ ID NO: 14520 it ends 5' TGGCAGTAAAAGGGTTAA-3' (SEQ ID NO: 14529), in SEQ ID NO: 14522 it ends 5'-TGGCAGTGAAAGGGT-TAA-3' (SEQ ID NO: 14531.) One embodiment of the invention is a transposon that comprises a heterologous polynucleotide inserted between two transposon ends each comprising SEQ ID NO: 14533 in inverted orientations in the two transposon ends. In certain embodiments, one transposon end comprises a sequence selected from SEQ ID NOS: 14524, SEQ ID NO: 14526 and SEQ ID NO: 14527. In some embodiments, one transposon end comprises a sequence selected from SEQ ID NO: 14529 and SEQ ID NO: 14531.

In certain embodiments, the piggyBac™ (PB) or piggyBac-like transposon is isolated or derived from *Xenopus tropicalis*. In certain embodiments, the piggyBac or piggyBac-like transposon comprises at a sequence of:

```
                                              (SEQ ID NO: 14573)
  1   ccctttgcct gccaatcacg catgggatac gtcgtggcag taaaagggct taaatgccaa
 61   cgacgcgtcc catacgtt.
```

In certain embodiments, the piggyBac or piggyBac-like transposon comprises at a sequence of:

```
                                              (SEQ ID NO: 14574)
  1   cctgggtaaa ctaaaagtcc cctcgaggaa aggccctaa agtgaaacag tgcaaaacgt
 61   tcaaaaactg tctggcaata caagttccac tttgggacaa atcggctggc agtgaaaggg.
```

In certain embodiments, the piggyBac or piggyBac-like transposon comprises at least 16 contiguous bases from SEQ ID NO: 14573 or SEQ ID NO: 14574, and inverted terminal repeat of CCYTTTBMCTGCCA (SEQ ID NO: 14575).

In certain embodiments, the piggyBac or piggyBac-like transposon comprises at a sequence of:

```
                                              (SEQ ID NO: 14579)
  1   ccctttgcct gccaatcacg catgggatac gtcgtggcag taaaagggct taaatgccaa
 61   cgacgcgtcc catacgttgt tggcatttta agtcttctct ctgcagcggc agcatgtgcc
121   gccgctgcag agagtttcta gcgatgacag cccctctggg caacgagccg gggggctgt
181   c.
```

In certain embodiments, the piggyBac or piggyBac-like transposon comprises at a sequence of:

```
                                              (SEQ ID NO: 14580)
  1   ccttttact gccaatgacg catgggatac gtcgtggcag taaaagggct taaatgccaa
 61   cgacgcgtcc catacgttgt tggcatttta attcttctct ctgcagcggc agcatgtgcc
121   gccgctgcag agagtttcta gcgatgacag cccctctggg caacgagccg gggggctgt
181   c.
```

In certain embodiments, the piggyBac or piggyBac-like transposon comprises at a sequence of:

```
                                              (SEQ ID NO: 14581)
  1   ccttttact gccaatgacg catgggatac gtcgtggcag taaaagggct taaatgccaa
 61   cgacgcgtcc catacgttgt tggcatttta agtcttctct ctgcagcggc agcatgtgcc
121   gccgctgcag agagtttcta gcgatgacag cccctctggg caacgagccg gggggctgt
181   c.
```

In certain embodiments, the piggyBac or piggyBac-like transposon comprises at a sequence of:

```
                                                  (SEQ ID NO: 14582)
  1    ccttttact gccaatgacg catgggatac gtcgtggcag taaaagggct taaatgccaa 61    cgacgcgtcc catacgttgt tggcatttta agtcttctct ctgcagcggc agcatgtgcc 121    gccgctgcag agag.
```

In certain embodiments, the piggyBac or piggyBac-like transposon comprises at a sequence of:

```
                                                  (SEQ ID NO: 14583)
  1    ccttttact gccaatgacg catgggatac gtcgtggcag taaaagggct taaatgccaa 61    cgacgcgtcc catacgttgt tggcatttta agtctt.
```

In certain embodiments, the piggyBac or piggyBac-like transposon comprises at a sequence of:

```
                                                  (SEQ ID NO: 14584)
  1    ccctttgcct gccaatcacg catgggatac gtcgtggcag taaaagggct taaatgccaa 61    cgacgcgtcc catacgttgt tggcatttta agtctt .
```

In certain embodiments, the piggyBac or piggyBac-like transposon comprises at a sequence of:

```
                                                  (SEQ ID NO: 14585)
  1    ttatcctttt tactgccaat gacgcatggg atacgtcgtg gcagtaaaag ggcttaaatg 61    ccaacgacgc gtcccatacg ttgttggcat tttaagtctt ctctctgcag cggcagcatg 121    tgccgccgct gcagagagtt tctagcgatg acagcccctc tgggcaacga gccggggggg 131    ctgtc.
```

In certain embodiments, the piggyBac or piggyBac-like transposon comprises at a sequence of;

```
                                                  (SEQ ID NO: 14586)
  1    tttgcatttt tagacattta gaagcctata tcttgttaca gaattggaat tacacaaaaa 61    ttctaccata ttttgaaagc ttaggttgtt ctgaaaaaaa caatatattg ttttcctggg 121    taaactaaaa gtcccctcga ggaaaggccc ctaaagtgaa acagtgcaaa acgttcaaaa 161    actgtctggc aatacaagtt ccactttggg acaaatcggc tggcagtgaa aggg.
```

In certain embodiments, the piggyBac or piggyBac-like transposon comprises a left transposon end sequence selected from SEQ ID NO: 14573 and SEQ ID NOs: 14579-14585. In certain embodiments, the left transposon end sequence is preceded by a left target sequence. In certain embodiments, the piggyBac or piggyBac-like transposon comprises at a sequence of:

```
                                                  (SEQ ID NO: 14587)
  1    tttgcatttt tagacattta gaagcctata tcttgttaca gaattggaat tacacaaaaa 61    ttctaccata ttttgaaagc ttaggttgtt ctgaaaaaaa caatatattg ttttcctggg 121    taaactaaaa gtcccctcga ggaaaggccc ctaaagtgaa acagtgcaaa acgttcaaaa 181    actgtctggc aatacaagtt ccactttgac caaaacggct ggcagtaaaa ggg.
```

In certain embodiments, the piggyBac or piggyBac-like transposon comprises at a sequence of:

```
                                                (SEQ ID NO: 14588)
  1  ttgttctgaa aaaaacaata tattgttttc ctgggtaaac taaaagtccc ctcgaggaaa 61  ggcccctaaa gtgaaacagt gcaaaacgtt caaaaactgt ctggcaatac aagttccact 121  ttgaccaaaa cggctggcag taaaaggg.
```

In certain embodiments, the piggyBac or piggyBac-like transposon comprises at a sequence of:

```
                                                (SEQ ID NO: 14589)
  1  tttgcatttt tagacattta gaagcctata tcttgttaca gaattggaat tacacaaaaa 61  ttctaccata ttttgaaagc ttaggttgtt ctgaaaaaaa caatatattg ttttcctggg 121  taaactaaaa gtcgcctcga ggaaaggccc ctaaagtgaa acagtgcaaa acgttcaaaa 181  actgtctggc aatacaagtt ccactttgac caaaacggct ggcagtaaaa gggttat.
```

In certain embodiments, the piggyBac or piggyBac-like transposon comprises at a sequence of:

```
                                                (SEQ ID NO: 14590)
  1  ttgttctgaa aaaacaata tattgttttc ctgggtaaac taaaagtccc ctcgaggaaa 61  ggcccctaaa gtgaaacagt gcaaaacgtt caaaaactgt ctggcaatac aagttccact 121  ttgggacaaa tcggctggca gtgaaaggg.
```

In certain embodiments, the piggyBac or piggyBac-like transposon comprises a right transposon end sequence selected from SEQ ID NO: 14574 and SEQ ID NOs: 14587-14590. In certain embodiments, the right transposon end sequence is followed by a right target sequence. In certain embodiments, the left and right transposon ends share a 14 repeated sequence inverted in orientation in the two ends (SEQ ID NO: 14575) adjacent to the target sequence. In certain embodiments, the piggyBac or piggyBac-like transposon comprises a left transposon end comprising a target sequence and a sequence that is selected from SEQ ID NOs: 14582-14584 and 14573, and a right transposon end comprising a sequence selected from SEQ ID NOs: 14588-14590 and 14574 followed by a right target sequence.

In certain embodiments, the left transposon end of the piggyBac or piggyBac-like transposon comprises

```
                                                (SEQ ID NO: 14591)
  1  atcacgcatg ggatacgtcg tggcagtaaa agggcttaaa tgccaacgac gcgtcccata
 61  cgtt,
``` and an ITR. In certain embodiments, the left transposon end comprises

```
                                                (SEQ ID NO: 14592)
  1  atgacgcatg ggatacgtcg tggcagtaaa agggcttaaa tgccaacgac gcgtcccata 61  cgttgttggc attttaagtc tt
``` and an ITR In certain embodiments, the right transposon end of the piggyBac or piggyBac-like transposon comprises

```
                                                        (SEQ ID NO: 14593)
  1   cctgggtaaa ctaaaagtcc cctcgaggaa aggcccctaa agtgaaacag tgcaaaacgt 61   tcaaaaactg tctggcaata caagttccac tttgggacaa atcggc
``` and an ITR. In certain embodiments, the right transposon end comprises

```
                                                        (SEQ ID NO: 14594)
  1   ttgttctgaa aaaacaata tattgttttc ctgggtaaac taaaagtccc ctcgaggaa 61   ggcccctaaa gtgaaacagt gcaaaacgtt caaaaactgt ctggcaatac aagttccact 121   ttgaccaaaa cggc
``` and an ITR.

In certain embodiments, one transposon end comprises a sequence that is at least 90%, at least 95%, at least 99% or any percentage in between identical to SEQ ID NO: 14573 and the other transposon end comprises a sequence that is at least 90%, at least 95%, at least 99% or any percentage in between identical to SEQ ID NO: 14574. In certain embodiments, one transposon end comprises at least 14, at least 16, at least 18, at least 20 or at least 25 contiguous nucleotides from SEQ ID NO: 14573 and one transposon end comprises at least 14, at least 16, at least 18, at least 20 or at least 25 contiguous nucleotides from SEQ ID NO: 14574. In certain embodiments, one transposon end comprises at least 14, at least 16, at least 18, at least 20 from SEQ ID NO: 14591, and the other end comprises at least 14, at least 16, at least 18, at least 20 from SEQ ID NO: 14593. In certain embodiments, each transposon end comprises SEQ ID NO: 14575 in inverted orientations.

In certain embodiments, the piggyBac or piggyBac-like transposon comprises a sequence selected from of SEQ ID NO: 14573, SEQ ID NO: 14579, SEQ ID NO: 14581, SEQ ID NO: 14582, SEQ ID NO: 14583, and SEQ ID NO: 14588, and a sequence selected from SEQ ID NO: 14587, SEQ ID NO: 14588, SEQ ID NO: 14589 and SEQ ID NO: 14586 and the piggyBac or piggyBac-like transposase comprises SEQ ID NO: 14517 or SEQ ID NO: 14518.

In certain embodiments, the piggyBac or piggyBac-like transposon comprises ITRs of CCCTITGCCTGCCA (SEQ ID NO: 14622) (left ITR) and TGGCAGTGAAAGGG (SEQ ID NO: 14623) (right ITR) adjacent to the target sequences.

In certain embodiments of the methods of the disclosure, the transposase enzyme is a piggyBac or piggyBac-like transposase enzyme. In certain embodiments, the piggyBac or piggyBac-like transposase enzyme is isolated or derived from *Helicoverpa armigera*. The piggyBac or piggyBac-like transposase enzyme may comprise or consist of an amino acid sequence at least 5%, 10%, 15%, 20%, 25%, 30% 35%, 40%, 45%, 50%, 55%, 60%, 65%, 70%, 75%, 80%, 85%, 90%, 95%, 99% or any percentage in between identical to:

```
                                                        (SEQ ID NO: 14525)
  1   MASRQRLNHD EIATILENDD DYSPLDSESE KEDCVVEDDV WSDNEDAIVD FVEDTSAQED

61   PDNNIASRES PNLEVTSLTS HRIITLPQRS IRGKNNHVWS TTKGRTTGRT SAINIIRTNR

121   GPTRMCRNIV DPLLCFQLFI TDEIIHEIVK WTNVEIIVKR QNLKDISASY RDTNTMEIWA

181   LVGILTLTAV MKDNHLSTDE LFDATFSGTR YVSVMSREREF EFLIRCIRMD DKTLRPTLRS

241   DDAFLPVRKI WEIFINQCRQ NHVPGSNLTV DEQLLGFRGR CPFRMYIPNK PDKYGIKFPM

301   MCAAATKYMI DAIPYLGKST KTNGLPLGEF YVKDLTKTVH GTNRNITCDN WFTSIPLAKN

361   MLQAPYNLTI VGTIRSNKRE MPEEIKNSRS RPVGSSMFCF DGPLTLVSYK PKPSKMVFLL

421   SSCDENAVIN ESNGKPDMIL FYNQTKGGVD SFDQMCKSMS ANRKTNRWPM AVFYGMLNMA

481   FVNSYIIYCH NKINKQEKPI SRKEFMKKLS IQLTTPWMQE RLQAPTLKRT LRDNITNVLK

541   NVVPASSENI SNEPEPKKRR YCGVCSYKKR RMTKAQCCKC KKAICGEHNI DVCQDCI.
```

In certain embodiments, the piggyBac or piggyBac-like transposon is isolated or derived from *Helicoverpa armigera*. In certain embodiments, the piggyBac or piggyBac-like transposon comprises a sequence of:

(SEQ ID NO: 14570)

```
  1  ttaaccctag aagcccaatc tacgtaaatt tgacgtatac cgcggcgaaa tatctctgtc
 61  tctttcatgt ttaccgtcgg atcgccgcta acttctgaac caactcagta gccattggga
121  cctcgcagga cacagttgcg tcatctcggt aagtgccgcc atcttgttgt actctctatt
161  acaacacacg tcacgtcacg tcgttgcacg tcattttgac gtataattgg gctttgtgta
241  acttttgaat ttgtttcaaa ttttttatgt ttgtgattta tttgagttaa tcgtattgtt
301  tcgttacatt tttcatataa taataatatt ttcaggttga gtacaaa.
```

In certain embodiments, the piggyBac or piggyBac-like transposon comprises a sequence of:

(SEQ ID NO: 14528)

```
  1  agactgtttt tttgtaagag acttctaaaa tattattacg agttgattta attttatgaa
 61  aacatttaaa actagttgat ttttttttata attacataat tttaagaaaa agtgttagag
121  gcttgattt tttgttgatt ttttctaaga tttgattaaa gtgccataat agtattaata
181  aagagtattt tttaacttaa aatgtatttt atttattaat taaaacttca attatgataa
241  ctcatgcaaa aatatagttc attaacagaa aaaaatagga aaactttgaa gttttgtttt
301  tacacgtcat ttttacgtat gattgggctt tatagctagt taaatatgat tgggcttcta
361  gggttaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Pectinophora gossypiella*. The piggyBac or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

(SEQ ID NO: 14530)

```
  1  MDLRKQDEKI RQWLEQDIEE DSKGESDNSS SETEDIVEME VHKNTSSESE VSSESDYEPV
 61  CPSKRQRTQI IESEESDNSE SIRPSRRQTS RVIDSDETDE DVMSSTPQNI PRNPNVIQPS
121  SRFLYGKNKH KWSSAAKPSS VRTSRRNIIH FIPGPKERAR EVSEPIDIFS LFISEDMLQQ
181  VVTFTNAEML IRKNKYKTET FTVSPTNLEE IRALLGLLFN AAAMKSNHLP TRMLFNTHRS
241  GTIFKACMSA ERLNFLIKCL RFDDKLTRNV RQRDDRFAPI RDLWQALISN FQKWYTPGSY
301  ITVDEQLVGF RGRCSFRMYI PNKPNKYGIK LVMAADVNSK YIVNAIPYLG KGTDPQNQPL
361  ATFFIKEITS TLHGTNRNIT MDNWFTSVPL ANELLMAPYN LTLVGTLRSN KREIPEKLKN
421  SKSRAIGTSM FCYDGDKTLV SYKAKSNKVV FILSTIHDQP DINQETGKPE MIHFYNSTKG
481  AVDTVDQMCS SISTNRKTQR WPLCVFYNML NLSIINAYVV YVYNNVRNNK KPMSRRDFVI
541  KLGDQLMEPW LRQRLQTVTL RRDIKVMIQD ILGESSDLEA PVPSVSNVRK IYYLCPSKAR
601  RMTKHRCIKC KQAICGPHNI DICSRCIE.
```

In certain embodiments, the piggyBac or piggyBac-like transposon is isolated or derived from *Pectinophora gossypiella*. In certain embodiments, the piggyBac or piggyBac-like transposon comprises a sequence of:

(SEQ ID NO: 14532)
```
  1  ttaaccctag ataactaaac attcgtccgc tcgacgacgc gctatgccgc gaaattgaag 61  tttacctatt attccgcgtc ccccgccccc gccgcttttt ctagcttcct gatttgcaaa 121  atagtgcatc gcgtgacacg ctcgaggtca cacgacaatt aggtcgaaag ttacaggaat 181  ttcgtcgtcc gctcgacgaa agtttagtaa ttacgtaagt ttggcaaagg taagtgaatg 241  aagtattttt ttataattat tttttaattc tttatagtga taacgtaagg tttatttaaa 301  tttattactt ttatagttac ttagccaatt gttataaatt ccttgttatt gctgaaaaat 361  ttgcctgttt tagtcaaaat ttattaactt ttcgatcgtt ttttag.
```

In certain embodiments, the piggyBac or piggyBac-like transposon comprises a sequence of:

(SEQ ID NO: 14571)
```
  1  tttcactaag taattttgtt cctatttagt agataagtaa
     cacataatta ttgtgatatt 61  caaaacttaa gaggtttaat aaataataat aaaaaaaaaa
     tggttttttat ttcgtagtct 121  gctcgacgaa tgtttagtta ttacgtaacc gtgaatatag
     tttagtagtc tagggttaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Ctenoplusia agnata*. The piggyBac or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

(SEQ ID NO: 14534)
```
  1  MASRQHLYQD EIAAILENED DYSPHDTDSE MEDCVTQDDV
     RSDVEDEMVD NIGNGTSPAS

61  RHEDPETPDP SSEASNLEVT LSSHRIIILP QRSIREKNNH
     IWSTTKGQSS GRTAAINIVR

121  TNRGPTRMCR NIVDPLLCFQ LFIKEEIVEE IVKWTNVEMV
     QKRVNLKDIS ASYRDTNEME

181  IWAIISMLTL SAVMKDNHLS TDELFNVSYG TRYVSVMSRE
     RFEFLLRLLR MGDKLLRPNL

241  RQEDAFTPVR KIWEIFINQC RLNYVPGTNL TVDEQLLGFR
     GRCPFRMYIP NKPDKYGIKF

301  PMVCDAATKY MVDAIPYLGK STKTQGLPLG EFYVKELTQT
     VHGTNRNVTC DNWFTSVPLA

361  KSLLNSPYNL TLVGTIRSNK REIPEEVKNS RSRQVGSSMF
     CFDGPLTLVS YKPKPSKMVF

421  LLSSCNEDAV VNQSNGKPDM ILFYNQTKGG VDSFDQMCSS
     MSTNRKTNRW PMAVFYGMLN

481  MAFVNSYIIY CHNMLAKKEK PLSRKDFMKK LSTDLTTPSM
     QKRLEAPTLK RSLPDNITNV

541  LKIVPQAAID TSFDEPEPKK RRYCGFCSYK KKRMTKTQCF
     KCKKPVCGEH NIDVCQDCI.
```

In certain embodiments, the piggy Bac or piggyBac-like transposon is isolated or derived from *Ctenoplusia agnata*. In certain embodiments, the piggyBac or piggyBac-like transposon comprises a sequence of:

(SEQ ID NO: 14535)
```
  1  ttaaccctag aagcccaatc tacgtcattc tgacgtgtat
     gtcgccgaaa atactctgtc 61  tctttctcct gcacgatcgg attgccgcga acgctcgatt
     caacccagtt ggcgccgaga 121  tctattggag gactgcgcg ttgattcggt aagtcccgcc
     attttgtcat agtaacagta 181  ttgcacgtca gcttgacgta tatttgggct ttgtgttatt
     tttgtaaatt ttcaacgtta 241  gtttattatt gcatcttttt gttacattac tggtttattt
     gcatgtatta ctcaaatatt 301  atttttattt tagcgtagaa aataca.
```

In certain embodiments, the piggyBac or piggyBac-like transposon comprises a sequence of (SEQ ID NO: 14536)
```
  1  agactgtttt ttttgtattt gcattatata ttatattcta
     aagttgattt aattctaaga 61  aaaacattaa aataagtttc tttttgtaaa atttaattaa
     ttataagaaa aagtttaagt 121  tgatctcatt ttttataaaa atttgcaatg tttccaaagt
     tattattgta aaagaataaa 181  taaaagtaaa ctgagtttta attgatgttt tattatatca
     ttatactata tattacttaa 241  ataaaacaat aactgaatgt atttctaaaa ggaatcacta
     gaaaatatag tgatcaaaaa 301  tttacacgtc attttttgcgt atgattgggc tttataggtt
     ctaaaaatat gattgggcct 361  ctagggttaa.
```

In certain embodiments, the piggyBac or piggyBac-like transposon comprises an ITR sequence of CCCTAGAAGCCCAATC (SEQ ID NO: 14564).

In certain embodiments of the methods of the disclosure, the transposase enzyme is a piggyBac or piggyBac-like transposase enzyme. In certain embodiments, the piggyBac or piggyBac-like transposase enzyme is isolated or derived from *Agrotis ipsilon*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                    (SEQ ID NO: 14537)
  1 MESPQRLNQD EIATILENDD DYSPLDSDSE AEDRVVEDDV
    WSDNEDAMID YVEDTSRQED

61 PDNNIASQES ANLEVTSLTS HRIISLPQRS ICGKNNHVWS
    TTKGRTTGRT SAINIIRTNR

121 GPTRMCRNIV DPLICFQLFI TDEIIHEIVK WTNVEMIVKR
    QNLIDISASY RDTNTMEMWA

181 LVGILTLTAV MKDNHLSTDE LFDATFSGTR YVSVMSREPF
    EFLIRCMRMD DKTLRPTLRS

241 DDAFIPVRKL WEIFINQCRL NYVPGGNLTV DEQLLGFRGR
    CPFRMYIPNK PDKYGIRFPM

301 MCDAATKYMI DAIPYLGKST KTNGLPLGEF YVKELTKTVH
    GTNRNVTCDN WFTSIPLAKN

361 MLQAPYNLTI VGTIRSNKRE IPEEIKNSRS RPVGSSMFCF
    DGPLTLVSYK PKPSRMVFLL

421 SSCDENAVIN ESNGKPDMIL FYNQTKGGVD SFDQMCKSMS
    ANRKTNRWPM AVFYGMLNMA

481 FVNSYIIYCH NKINKQKKPI NRKEFMKNLS TDLTTPWMQE
    RLKAPTLKRT LRDNITNVLK

541 NVVPPSPANN SEEPGRKKRS YCGFCSYKKR RMTKTQFYKC
    KKAICGEHNT DVCQDCV.
```

In certain embodiments, the piggyBac or piggyBac-like transposon is isolated or derived from *Agrotis ipsilon*. In certain embodiments, the piggyBac or piggyBac-like transposon comprises a sequence of:

```
                                    (SEQ ID NO: 14538)
  1 ttaaccctag aagcccaatc tacgtaaatt tgacgtatac
    cgcggcgaaa tatatctgtc 61 tctttcacgt ttaccgtcgg attcccgcta acttcggaac
    caactcagta gccattgaga 121 actcccagga cacagttgcg tcatctcggt aagtgccgcc
    attttgttgt aatagacagg 181 ttgcacgtca ttttgacgta taattgggct ttgtgtaact
    tttgaaatta tttataattt 241 ttattgatgt gatttatttg agttaatcgt attgtttcgt
    tacatttttc atatgatatt 301 aatattttca gattgaatat aaa.
```

In certain embodiments, the piggyBac or piggy Bac-like transposon comprises a sequence of:

```
                                    (SEQ ID NO: 14539)
  1 agactgtttt ttttaaaagg cttataaagt attactattg
    cgtgatttaa ttttataaaa 61 atatttaaaa ccagttgatt tttttaataa ttacctaatt
    ttaagaaaaa atgttagaag 121 cttgatatttt ttagttgattt ttttctaaga tttgattaaa
    aggccataat tgtattaata 181 aagagtattt ttaacttcaa atttatttta tttattaatt
    aaaacttcaa ttatgataat 241 acatgcaaaa atatagttca tcaacagaaa aatataggaa
    aactctaata gtttttatttt 301 tacacgtcat ttttacgtat gattgggctt tatagctagt
    caaatatgat tgggcttcta 351 gggttaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Megachile rotundata*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                    (SEQ ID NO: 14540)
  1 MNGKDSLGEF YLDDLSDCLD CRSASSTDDE SDSSNIAIRK
    RCRIPLIYSD SEDEDMNNNV

61 EDNNHFVKES NRYHYQIVEK YKITSKTKKW KDVTVTEMKK
    FLGLIILMGQ VKKDVLYDYW

121 STDPSIETPF FSKVMSRNRF LQIMQSWHFY NNNDISPNSH
    RLVKIQPVID YFKEKFNNVY

181 KSDQQLSLDE CLIPWRGRLS IKTYNPAKIT KYGILVRVLS
    EARTGYVSNF CVYAADGKKI

241 EETVLSVIGP YKNMWHHVYQ DNYYNSVNIA KIFLKNKLRV
    CGTIRKNRSL PQILQTVKLS

301 RGQHQFLRNG HTLLEVWNNG KRNVNMISTI HSAQMAESRN
    RSRTSDCPIQ KPISIIDYNK

361 YMKGVDRADQ YLSYYSIFRK TKKWTKRVVM FFINCALFNS
    FKVYTTLNGQ KITYKNFLHK

421 AALSLIEDCG TEEQGTDLPN SEPTTTRTTS RVDHPGRIEN
    FGKHKLVNIV TSGQCKKPLR

481 QCRVCASKKK LSRTGFACKY CNVPLHKGDC FERYHSLKKY.
```

In certain embodiments, the piggyBac or piggyBac-like transposon is isolated or derived from *Megachile rotundata*. In certain embodiments, the piggyBac or piggyBac-like transposon comprises a sequence of:

```
                                    (SEQ ID NO: 14541)
  1 ttaaataatg cccactctag atgaacttaa cactttaccg
    accggccgtc gattattcga 61 cgtttgctcc ccagcgctta ccgaccggcc atcgattatt
    cgacgtttgc ttcccagcgc 121 ttaccgaccg gtcatcgact tttgatcttt ccgttagatt
    tggttaggtc agattgacaa 181 gtagcaagca tttcgcattc tttattcaaa taatcggtgc
    tttttctaa gctttagcccc 241 ttagaa.
```

In certain embodiments, the piggyBac or piggyBac-like transposon comprises a sequence of:

```
                                    (SEQ ID NO: 14542)
  1 acaacttctt ttttcaacaa atattgttat atggattatt
    tatttattta tttatttatg 61 gtatatttta tgtttattta tttatggtta ttatggtata
    ttttatgtaa ataataaact 121 gaaacgatt gtaatagatg aaataaatat tgtttttaaca
    ctaatataat taaagtaaaa
```

```
181 gattttaata aatttcgtta ccctacaata acacgaagcg
    tacaatttta ccagagttta 241 ttaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Bombus impatiens*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                          (SEQ ID NO: 14543)
  1 MNEKNGIGEF YLDDLSDCPD SYSRSNSGDE SDGSDTIIRK
    RGSVLPPRYS DSEDDEINNV

61 EDNANNVENN DDIWSTNDEA IILEPFEGSP GLKIMPSSAE
    SVTDNVNLFF GDDFFEHLVR

121 ESNRYHYQVM EKYKIPSKAK KWTDITVPEM KKFLGLIVLM
    GQIKKDVLYD YWSTDPSIET

181 PFFSQVMSRN RFVQIMQSWH FCNNDNIPHD SHRLAKIQPV
    IDYFRRKFND VYKPCQQLSL

241 DESIIPWPGR LSIKTYNPAK ITKYGILVRV LSEAVTGYVC
    NEFDYAADGK KLEDTAVIEP

301 YKNIWHQIYQ DNYYNSVKMA RILLKNKVRV CGTIRKNRGL
    PRSLKTIQLS RGQYEFRRNH

361 QILLEVWNNG RRNVNMISTI HSAQLMESRS KSKRSDVPIQ
    KPNSIIDYNK YMKGVDRADQ

421 YLAYYSIFRK TKKWTKRVVM FFINCALFNS FRVYTILNGK
    NITYKNFLHK VAVSWIEDGE

481 TNCTEQDDNL PNSEPTRRAP RLDHPGRLSN YGKHKLINIV
    TSGRSLKPQR QCRVCAVQKK

541 RSRTCFVCKF CNVPLHKGDC FERYHTLKKY.
```

In certain embodiments, the piggyBac or piggyBac-like transposon is isolated or derived from *Bombus impatiens*. In certain embodiments, the piggyBac or piggy Bac-like transposon comprises a sequence of:

```
                                          (SEQ ID NO: 14544)
  1 ttaattttt aacattttac cgaccgatag ccgattaatc
    gggtttttgc cgctgacgct 61 taccgaccga taacctatta atcggctttt tgtcgtcgaa
    gcttaccaac ctatagccta 121 cctatagtta atcggttgcc atggcgataa acaatctttc
    tcattatatg agcagtaatt 181 tgttatttag tactaaggta ccttgctcag ttgcgtcagt
    tgcgttgctt tgtaagctcc 241 cacagtttta taccaattcg aaaaacttac cgttcgcg.
```

In certain embodiments, the piggyBac or piggyBac-like transposon comprises a sequence of

```
                                          (SEQ ID NO: 14545)
  1 actatttcac atttgaacta aaaaccgttg taatagataa
    aataaatata atttagtatt
```

```
 61 aatattatgg aaacaaaaga ttttattcaa tttaattatc
    ctatagtaac aaaaagcggc 121 caatttatc tgagcatacg aaaagcacag atactcccgc
    ccgacagtct aaaccgaaac 181 agagccggcg ccagggagaa tctgcgcctg agcagccggt
    cggacgtgcg tttgctgttg 241 aaccgctagt ggtcagtaaa ccagaaccag tcagtaagcc
    agtaactgat cagttaacta 301 gattgtatag ttcaaattga acttaatcta gtttttaagc
    gtatgaatgt tgtctaactt 361 cgttatatat tatattcttt ttaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Mamestra brassicae*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                          (SEQ ID NO: 14546)
  1 MFSFVPNKEQ TRTVLIFCFH LKTTAAESHR PLVEAFGEQV
    PTVKTCERWF QRFKSGDFDV

61 DDKEHGKPPK RYEDAELQAL LDEDDAQTQK QLAEQLEVSQ
    QAVSNRLREG GKIQKVGRWV

121 PHELNERQRE RRKNTCEILL SRYKRKSFLH RIVTGEEKWI
    FFVNPKRKKS YVDPGQPATS

181 TARPNRFGKK TRLCVWWDQS GVIYYELLKP GETVNTARYQ
    QQLINLNRAL QRKRPEQKR

241 QHRVIFLHDN APSHTARAVR DTLETLNWEV LPHAAYSPDL
    APSDYHLFAS MGHALAEQRF

301 DSYESVEEWL DEWFAAKDDE FYWRGIHKLP ERWDNCVASD
    GKYFE.
```

In certain embodiments, the piggyBac or piggyBac-like transposon is isolated or derived from *Mamestra brassicae*. In certain embodiments, the piggyBac or piggyBac-like transposon comprises a sequence of:

```
                                          (SEQ ID NO: 14547)
  1 ttattgggtt gcccaaaaag taattgcgga tttttcatat
    acctgtcttt taaacgtaca 61 tagggatcga actcagtaaa actttgacct tgtgaaataa
    caaacttgac tgtccaacca 121 ccatagtttg gcgcgaattg agcgtcataa ttgtttgac
    tttttgcagt caac.
```

In certain embodiments, the piggyBac or piggyBac-1e transposon comprises a sequence of:

```
                                          (SEQ ID NO: 14548)
  1 atgattttt cttttttaaac caattttaat
    tagttaattg atataaaaat ccgcaattac 61 tttttgggca acccaataa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Mayetiola destructor*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65% 70%, 75% 80% 85% 90%, 95% 99% or any percentage in between identical to:

```
                                          (SEQ ID NO: 14549)
  1 MENFENWRKR RHLREVLLGH FFAKKTAAES
    HRLLVEVYGE HALAKTQCFE WFQRFKSGDF
 61 DTEDKERPGQ PKKFEDEELE ALLDEDCCQT
    QEELAKSLGV TQQAISKRLK AAGYIQKQGN
121 WVPHELKPRD VERRFCMSEM LLQRHKKKSF
    LSRIITGDEK WIHYDNSKRK KSYVKRGGRA
181 KSTPKSNLHG AKVMLCIKWD QRGVLYYELL
    EPGQTITGDL YRTQLIRLKQ ALAEKRPEYA
241 KRHGAVIFHH DNARPHVALP VKNYLENSGW
    EVLPHPPYSP DLAPSDYHLF RSMQNDLAGK
301 RFTSEQGIPK WLDSFLAAKP AKFFEKGIHE
    LSERWEKVIA SDGQYFE.
```

In certain embodiments, the piggy ac or piggyBac-like transposon is isolated or derived from *Mayetiola destructor*. In certain embodiments, the piggyBac or piggyBac-like transposon comprises a sequence of:

```
                                          (SEQ ID NO: 14550)
  1 taagacttcc aaaatttcca cccgaacttt
    accttccccg cgcattatgt ctctcttttc
 61 accctctgat ccctggtatt gttgtcgagc
    acgatttata ttgggtgtac aacttaaaaa
121 ccggaattgg acgctagatg tccacactaa
    cgaatagtgt aaaagcacaa atttcatata
181 tacgtcattt tgaaggtaca tttgacagct
    atcaaaatca gtcaataaaa ctattctatc
241 tgtgtgcatc atatttttt attaact.
```

In certain embodiments, the piggyBac or piggyBac-like transposon comprises a sequence of

```
                                          (seq ID NO: 14551)
  1 tgcattcatt cattttgtta tcgaaataaa
    gcattaattt ccactaaaaa attccggttt
 61 ttaagttgta cacccaatat catccttagt
    gacaattttc aaatggcttt cccattgagc
121 tgaaaccgtg gctatagtaa gaaaaacgcc
    caacccgtca tcatatgcct ttttttctc
161 aacatccg.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Apis mellifera*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                          (SEQ ID NO: 14552)
  1 MENQKEHYRH ILLFYFRKGK NASQAHKKLC
    AVYGDEALKE RQCQNWFDKF RSGDFSLKDE
 61 KRSGRPVEVD DDLIKAIIDS DRHSTTREIA
    EKLHVSHTCI ENHLKQLGYV QKLDTWVPHE
121 LKEKHLTQRI NSCDLLKKRN ENDPFLKRLI
    TGDEKWVVYN NIKRKRSWSR PREPAQTTSK
181 AGIHRKKVLL SVWWDYKGIV YFELLPPNRT
    INSVVYIEQL TKLNNAVEEK RPELTNRKGV
241 VFHHDNARPH TSLVTRQKLL ELGWDVLPHP
    PYSPDLAPSD YFLFRSLQNS LNGKNFNNDD
301 DIKSYLIQFF ANKNQKFYER GIMMLPERWQ
    KVIDQNGQHI TE.
```

In certain embodiments, the piggyBac or piggyBac-like transposon is isolated or derived from *Apis mellifera*. In certain embodiments, the piggyBac or piggyBac-like transposon comprises a sequence of:

```
                                          (SEQ ID NO: 14553)
  1 ttgggttggc aactaagtaa ttgcggattt
    cactcataga tggcttcagt tgaattttta
 61 ggtttgctgg cgtagtccaa atgtaaaaca
    cattttgtta tttgatagtt ggcaactcag
121 ctgtcaatca gtaaaaaaag tttttgatc
    ggttgcgtag ttttcgtttg gcgttcgttg
181 aaaa.
```

In certain embodiments, the piggyBac or piggyBac-like transposon comprises a sequence of:

```
                                          (SEQ ID NO: 14554)
  1 agttatttag ttccatgaaa aaattgtctt
    tgattttcta aaaaaaatcc gcaattactt
 61 agttgccaat ccaa.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Messor bouvieri*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 90%, 95%, 99% or any percentage in between identical to:

```
                                        (SEQ ID NO: 14555)
  1 MSSFVPENVH LRHALLFLFH QKKRAAESHR

LLVETYGEHA PTIRTCETWF RQFKCGDFNV

61 QDKERPGRPK TFEDAELQEL LDEDSTQTQK

QLAEKLNVSR VAICERLQAM GKIQKMGRWV

121 PHELNDRQME NRKIVSEMLL QRYERKSFLH

RIVTGDEKWI YFENPKRKKS WLSPGEAGPS

181 TARPNRFGRK TMLCVWWDQI GVVYYELLKP

GETVNTDRYR QQMINLNCAL IEKRPQYAQR

241 HDKVILQHDN APSHTAKPVK EMLKSLGWEV

LSHPPYSPDL APSDYHLFAS MGHALAEQHF

301 ADFEEVKKWL DEWFSSKEKL FFWNGIHKLS

ERWTKCIESN GQYFE.
```

In certain embodiments, the piggyBac or piggyBac-like transposon is isolated or derived from *Messor bouvieri*. In certain embodiments, the piggyBac or piggyBac-like transposon comprises a sequence of:

```
                                        (SEQ ID NO: 14556)
  1 agtcagaaat gacacctcga tcgacgacta atcgacgtct aatcgacgtc gattttatgt 61 caacatgtta ccaggtgtgt cggtaattcc tttccggttt ttccggcaga tgtcactagc 121 cataagtatg aaatgttatg atttgataca tatgtcattt taftctactg acattaacct 131 taaaactaca caagttacgt tccgccaaaa taacagcgtt atagatttat aattttttga 241 aa.
```

In certain embodiments, the piggyBac or piggyBac-like transposon comprises a sequence of:

```
                                        (SEQ ID NO: 14557)
  1 ataaatttga actatccatt ctaagtaacg tgttttcttt aacgaaaaaa ccggaaaaaa 61 attaccgaca ctcctggtat gtaaacatgt tattttcgac attgaatcgc gtcgattcga 121 agtcgatcga ggtgtcattt ctgact.
```

In certain embodiments of the methods of the disclosure, the transposase enzyme is a piggyBac or piggyBac-like transposase enzyme. In certain embodiments, the piggyBac or piggyBac-like transposase enzyme is isolated or derived from *Trichoplusia ni*. The piggyBac (PB) or piggyBac-like transposase enzyme may comprise or consist of an amino acid sequence at least 5%, 10%, 15%, 20%, 25%, 30%, 35%, 40%, 45%, 50%, 55%, 60%, 65%, 70%, 75%, 80%, 85%, 900%, 95%, 99% or any percentage in between identical to:

```
                                        (SEQ ID NO: 14558)
  1 MGSSLDDEHI LSALLQSDDE LVGEDSDSEV

SDHVSEDDVQ SDTEEAFIDE VHEVQPTSSG

61 SEILDEQNVI EQPGSSLASN RILTLPQRTI

RGKNKHCWST SKSTRRSRVS ALNIVRSQRG

121 PTRMCRNIYD PLLCFKLFFT DEIISEIVKW

TNAEISLKRR ESMTSATFRD TNEDEIYAFF

181 GILVMTAVRK DNHMSTDDLF DRSLSMVYVS

VMSRDRFDFL IRCLRMDDKS IRPTLRENDV

241 FTPVRKIWDL FIHQCIQNYT PGAHLTIDEQ

LLGFRGRCPF RVYIPNKPSK YGIKILMMCD

301 SGTKYMINGM PYLGRGTQTN GVPLGEYYVK

ELSKPVHGSC RNITCDNWFT SIPLAKNLLQ

361 EPYKLTIVGT VRSNKREIPE VLKNSRSRPV

GTSMECFDGP LTLVSYKPKP AKMVYLLSSC

421 DEDASINEST GKPQMVMYYN QTKGGVDTLD

QMCSVNTCSR KTNPWPMALL YGMINIACIN

481 SFIIYSHNVS SKGEKVQSRK KFMRNLYMSL

TSSEMPEPIE APTLKRYLRD NISNILPKEV

541 PGTSDDSTEE PVMKKRTYCT YCPSKIRRKA

NASCKKCKKV ICREHNIDMC QSCF.
```

In certain embodiments, the piggyBac or piggyBac-like transposon is isolated or derived from *Trichoplusia ni*. In certain embodiments, the piggyBac or piggyBac-like transposon comprises a sequence of:

```
                                        (SEQ ID NO: 14559)
  1 ttaaccctag aaagatagtc tgcgtaaaat tgacgcatgc attcttgaaa tattgctctc 61 tctttctaaa tagcgcgaat ccgtcgctgt gcatttagga cacctcagtc gccgcttgga 121 gctcccgtga ggcgtgcttg tcaatgcggt aagtgtcact gattttgaac tataacgacc 181 gcgtgagtca aaatgacgca tgattatctt ttacgtgact tttaagattt aactcatacg 241 ataattatat cgttatttca tgttctactt acgtgataac ttattatata tatattttct 301 tgttatagat atc.
```

In certain embodiments, the piggyBac or piggyBac-like transposon comprises a sequence of:

```
                                 (SEQ ID NO: 14560)
  1 tttgttactt tatagaagaa attttgagtt tttgtttttt ttcaataaat aaataaacat 61 aaataaattg tttgttgaat ttattattag tatgtaagtg taaatataat aaaacttaat 121 atctattcaa attaataaat aaacctcgat atacagaccg ataaaacaca tgcgccaatt 181 tcacgcatga ttatcttcaa cgtacgtcac aatatgatta tctttccagg gttaa
```

In certain embodiments, the piggyBac or piggyBac-like transposon comprises a sequence of:

```
                                 (SEQ ID NO: 14561)
  1 ccctagaaag atagtctgcg taaaattgac gcatgcattc ttgaaatatt gctctctctt 61 tctaaatagc gcgaatccgt cgctgtgcat ttaggacatc tcagtcgccg cttggagctc 121 ccgtgaggcg tgcttgtcaa tgcggtaagt gtcactgatt ttgaactata acgaccgcgt 181 gagtcaaaat gacgcatgat tatcttttac gtgactttta agatttaact catacgataa 241 ttatattgtt atttcatgtt ctacttacgt gataacttat tatatatata ttttcttgtt 301 atagatatc.
```

In certain embodiments, the piggyBac or piggyBac-like transposon comprises a sequence of:

```
                                 (SEQ ID NO: 14562)
  1 tttgttactt tatagaagaa attttgagtt tttgtttttt tttaataaat aaataaacat 61 aaataaattg tttgttgaat ttattattag tatgtaagtg taaatataat aaaacttaat 121 atctattcaa attaataaat aaacctcgat atacagaccg ataaaacaca tgcgtcaatt 181 ttacgcatga ttatctttaa cgtacgtcac aatatgatta tctttctagg g.
```

In certain embodiments, the piggyBac or piggyBac-like transposon comprises a sequence of:

```
                                 (SEQ ID NO: 14609)
  1 tctaaatagc gcgaatccgt cgctgtgcat ttaggacatc tcagtcgccg cttggagctc
```

-continued
```
 61 ccgtgaggcg tgcttgtcaa tgcggtaagt gtcactgatt ttgaactata acgaccgcgt 121 gagtcaaaat gacgcatga tatcttttac gtgactttta agattLaact catacgataa 181 ttatattgtt atttcatgtt ctacttacgt gataacttat tatatatata ttttcttgtt 241 atagatatc.
```

In certain embodiments, the piggyBac or piggyBac-like transposon comprises a sequence of:

```
                                 (SEQ ID NO: 14610)
  1 tttgttactt tatagaagaa attttgagtt tttgtttttt tttaataaat aaataaacat 61 aaataaattg tttgttgaat ttattattag tatgtaagtg taaatataat aaaacttaat 121 atccattcaa attaataaat aaacctcgat atacagaccg ataaaacaca tgcgtcaatt 181 ttacgcatga ttatctttaa cgtacgtcac aatatgatta tccttctagg g
```

In certain embodiments, the piggyBac or piggyBac-like transposon comprises SEQ ID NO: 14561 and SEQ ID NO: 14562, and the piggyBac or piggyBac-like transposase comprises SEQ ID NO: 14558. In certain embodiments, the piggyBac or piggyBac-like transposon comprises SEQ ID NO: 14609 and SEQ ID NO: 14610, and the piggyBac or piggyBac-like transposase comprises SEQ ID NO: 14558.

In certain embodiments, the piggyBac or piggyBac-like transposon is isolated or derived from *Aphis gossypii*. In certain embodiments, the piggyBac or piggyBac-like transposon comprises an ITR sequence of CCTTCCAGCGGGCGCGC (SEQ ID NO: 14565).

In certain embodiments, the piggyBac or piggyBac-like transposon is isolated or derived from *Chilo suppressalis*. In certain embodiments, the piggyBac or piggyBac-like transposon comprises an ITR sequence of CCCAGATTAGCCT (SEQ ID NO: 14566).

In certain embodiments, the piggyBac or piggyBac-like transposon is isolated or derived from *Heliothis virescens*. In certain embodiments, the piggyBac or piggyBac-like transposon comprises an ITR sequence of CCCTTAATTACTCGCG (SEQ ID NO: 14567).

In certain embodiments, the piggyBac or piggyBac-like transposon is isolated or derived from *Pectinophora gossypiella*. In certain embodiments, the piggyBac or piggyBac-like transposon comprises an ITR sequence of CCCTAGATAACTAAAC (SEQ ID NO: 14568).

In certain embodiments, the piggyBac or piggyBac-like transposon is isolated or derived from *Anopheles stephensi*. In certain embodiments, the piggyBac or piggyBac-like transposon comprises an ITR sequence of CCCTAGAAAGATA (SEQ ID NO: 14569).

Immune and Immune Precursor Cells

In certain embodiments, immune cells of the disclosure comprise lymphoid progenitor cells, natural killer (NK) cells, T lymphocytes (T-cell), stem memory T cells ($T_{SCM}$ cells), central memory T cells ($T_{CM}$), stem cell-like T cells, B lymphocytes (B-cells), myeloid progenitor cells, neutrophils, basophils, eosinophils, monocytes, macrophages, platelets, erythrocytes, red blood cells (RBCs), megakaryocytes or osteoclasts.

In certain embodiments, immune precursor cells comprise any cells which can differentiate into one or more types of immune cells. In certain embodiments, immune precursor cells comprise multipotent stem cells that can self renew and develop into immune cells. In certain embodiments, immune precursor cells comprise hematopoietic stem cells (HSCs) or descendants thereof. In certain embodiments, immune precursor cells comprise precursor cells that can develop into immune cells. In certain embodiments, the immune precursor cells comprise hematopoietic progenitor cells (HPCs).

Hematopoietic Stem Cells (HSCs)

Hematopoietic stem cells (HSCs) are multipotent, self-renewing cells. All differentiated blood cells from the lymphoid and myeloid lineages arise from HSCs. HSCs can be found in adult bone marrow, peripheral blood, mobilized peripheral blood, peritoneal dialysis effluent and umbilical cord blood.

HSCs of the disclosure may be isolated or derived from a primary or cultured stem cell. HSCs of the disclosure may be isolated or derived from an embryonic stem cell, a multipotent stem cell, a pluripotent stem cell, an adult stem cell, or an induced pluripotent stem cell (iPSC).

Immune precursor cells of the disclosure may comprise an HSC or an HSC descendent cell. Exemplary HSC descendent cells of the disclosure include, but are not limited to, multipotent stem cells, lymphoid progenitor cells, natural killer (NK) cells, T lymphocyte cells (T-cells), B lymphocyte cells (B-cells), myeloid progenitor cells, neutrophils, basophils, eosinophils, monocytes, and macrophages.

HSCs produced by the methods of the disclosure may retain features of "primitive" stem cells that, while isolated or derived from an adult stem cell and while committed to a single lineage, share characteristics of embryonic stem cells. For example, the "primitive" HSCs produced by the methods of the disclosure retain their "stemness" following division and do not differentiate. Consequently, as an adoptive cell therapy, the "primitive" HSCs produced by the methods of the disclosure not only replenish their numbers, but expand in vivo. "Primitive" HSCs produced by the methods of the disclosure may be therapeutically-effective when administered as a single dose. In some embodiments, primitive HSCs of the disclosure are CD34+. In some embodiments, primitive HSCs of the disclosure are CD34+ and CD38−. In some embodiments, primitive HSCs of the disclosure are CD34+, CD38− and CD90+. In some embodiments, primitive HSCs of the disclosure are CD34+. CD38−, CD90+ and CD45RA−. In some embodiments, primitive HSCs of the disclosure are CD34+, CD38−, CD90+, CD45RA−, and CD49f+. In some embodiments, the most primitive HSCs of the disclosure are CD34+, CD38−, CD90+, CD45RA−, and CD49f+.

In some embodiments of the disclosure, primitive HSCs, HSCs, and/or HSC descendent cells may be modified according to the methods of the disclosure to express an exogenous sequence (e.g. a chimeric antigen receptor or therapeutic protein). In some embodiments of the disclosure, modified primitive HSCs, modified HSCs, and/or modified HSC descendent cells may be forward differentiated to produce a modified immune cell including, but not limited to, a modified T cell, a modified natural killer cell and/or a modified B-cell of the disclosure.

T Cells

Modified T cells of the disclosure may be derived from modified hematopoietic stem and progenitor cells (HSPCs) or modified HSCs.

Unlike traditional biologics and chemotherapeutics, modified-T cells of the disclosure possess the capacity to rapidly reproduce upon antigen recognition, thereby potentially obviating the need for repeat treatments. To achieve this, in some embodiments, modified-T cells of the disclosure not only drive an initial response, but also persist in the patient as a stable population of viable memory T cells to prevent potential relapses. Alternatively, in some embodiments, when it is not desired, modified-T cells of the disclosure do not persist in the patient.

Intensive efforts have been focused on the development of antigen receptor molecules that do not cause T cell exhaustion through antigen-independent (tonic) signaling, as well as of a modified-T cell product containing early memory T cells, especially stem cell memory ($T_{SCM}$) or stem cell-like T cells. Stem cell-like modified-T cells of the disclosure exhibit the greatest capacity for self-renewal and multipotent capacity to derive central memory ($T_{CM}$) T cells or $T_{CM}$ like cells, effector memory ($T_{EM}$) and effector T cells ($T_E$), thereby producing better tumor eradication and long-term modified-T cell engraftment. A linear pathway of differentiation may be responsible for generating these cells: Naïve T cells $(T_N)>T_{SCM}>T_{CM}>T_{EM}>T_E>T_{TE}$, whereby $T_N$ is the parent precursor cell that directly gives rise to $T_{SCM}$, which then, in turn, directly gives rise to $T_{CM}$, etc. Compositions of T cells of the disclosure may comprise one or more of each parental T cell subset with $T_{SCM}$ cells being the most abundant (e.g. $T_{SCM}>T_{CM}>T_{EM}>T_E>T_{TE}$).

In some embodiments of the methods of the disclosure, the immune cell precursor is differentiated into or is capable of differentiating into an early memory T cell, a stem cell like T-cell, a Naïve T cells ($T_N$), a $T_{SCM}$, a $T_{CM}$, a $T_{EM}$, a $T_E$, or a $T_{TE}$. In some embodiments, the immune cell precursor is a primitive HSC, an HSC, or a HSC descendent cell of the disclosure.

In some embodiments of the methods of the disclosure, the immune cell is an early memory T cell, a stem cell like T-cell, a Naïve T cells ($T_N$), a $T_{SCM}$, a $T_{CM}$, a $T_{EM}$, a $T_E$, or a $T_{TE}$.

In some embodiments of the methods of the disclosure, the immune cell is an early memory T cell.

In some embodiments of the methods of the disclosure, the immune cell is a stem cell like T-cell.

In some embodiments of the methods of the disclosure, the immune cell is a $T_{SCM}$.

In some embodiments of the methods of the disclosure, the immune cell is a $T_{CM}$.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of an early memory T cell. In certain embodiments, the plurality of modified early memory T cells comprises at least one modified stem cell-like T cell. In certain embodiments, the plurality of modified early memory T cells comprises at least one modified $T_{SCM}$. In certain embodiments, the plurality of modified early memory T cells comprises at least one modified $T_{CM}$.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of a stem cell-like T cell. In certain embodiments, the plurality of modified stem cell-like T cells comprises at least one modified $T_{SCM}$. In certain embodiments, the plurality of modified stem cell-like T cells comprises at least one modified $T_{CM}$.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of a stem memory T cell ($T_{SCM}$). In certain embodiments, the cell-surface markers comprise CD62L and CD45RA. In certain embodiments, the cell-surface markers comprise one or more of CD62L, CD45RA, CD28, CCR7, CD127, CD45RO, CD95, CD95 and IL-2Rβ. In certain embodiments, the cell-surface markers comprise one or more of CD45RA, CD95, IL-2Rβ, CCR7, and CD62L.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of a central memory T cell ($T_{CM}$). In certain embodiments, the cell-surface markers comprise one or more of CD45RO, CD95, IL-2Rβ, CCR7, and CD62L.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of a naïve T cell ($T_N$). In certain embodiments, the cell-surface markers comprise one or more of CD45RA, CCR7 and CD62L.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of an effector T-cell (modified $T_{EFF}$). In certain embodiments, the cell-surface markers comprise one or more of CD45RA, CD95, and IL-2Rβ.

In some embodiments of the methods of the disclosure, the methods modify and/or the methods produce a plurality of modified T cells, wherein at least 2%, 5%, 10%, 15%, 20%, 25%, 30%, 35%, 40%, 45%, 50%, 60%, 65%, 70%, 75%, 80%, 85%, 90%, 95%, 99% or any percentage in between of the plurality of modified T cells expresses one or more cell-surface marker(s) of a stem cell-like T cell, a stem memory T cell ($T_{SCM}$) or a central memory T cell ($T_{CM}$).

In some embodiments of the methods of the disclosure, a buffer comprises the immune cell or precursor thereof. The buffer maintains or enhances a level of cell viability and/or a stem-like phenotype of the immune cell or precursor thereof, including T-cells. In certain embodiments, the buffer maintains or enhances a level of cell viability and/or a stem-like phenotype of the primary human T cells prior to the nucleofection. In certain embodiments, the buffer maintains or enhances a level of cell viability and/or a stem-like phenotype of the primary human T cells during the nucleofection. In certain embodiments, the buffer maintains or enhances a level of cell viability and/or a stem-like phenotype of the primary human T cells following the nucleofection. In certain embodiments, the buffer comprises one or more of KCl, MgCl$_2$, ClNa, Glucose and Ca(NO$_3$)$_2$ in any absolute or relative abundance or concentration, and, optionally, the buffer further comprises a supplement selected from the group consisting of HEPES, Tris/HCl, and a phosphate buffer. In certain embodiments, the buffer comprises 5 mM KCl, 15 mM MgCl2, 90 mM ClNa, 10 mM Glucose and 0.4 mM Ca(NO$_3$)$_2$. In certain embodiments, the buffer comprises 5 mM KCl, 15 mM MgCl$_2$, 90 mM ClNa, 10 mM Glucose and 0.4 mM Ca(NO$_3$)$_2$ and a supplement comprising 20 mM HEPES and 75 mM Tris/HCl. In certain embodiments, the buffer comprises 5 mM KCl, 15 mM MgCl$_2$, 90 mM ClNa, 10 mM Glucose and 0.4 mM Ca(NO$_3$)$_2$ and a supplement comprising 40 mM Na$_2$HPO$_4$/NaH$_2$PO$_4$ at pH 7.2. In certain embodiments, the composition comprising primary human T cells comprises 100 µl of the buffer and between 5×10$^6$ and 25×10$^6$ cells. In certain embodiments, the composition comprises a scalable ratio of 250×10$^6$ primary human T cells per milliliter of buffer or other media during the introduction step.

In some embodiments of the methods of the disclosure, the methods comprise contacting an immune cell of the disclosure, including a T cell of the disclosure, and a T-cell expansion composition. In some embodiments of the methods of the disclosure, the step of introducing a transposon and/or transposase of the disclosure into an immune cell of the disclosure may further comprise contacting the immune cell and a T-cell expansion composition. In some embodiments, including those in which the introducing step of the methods comprises an electroporation or a nucleofection step, the electroporation or a nucleofection step may be performed with the immune cell contacting T-cell expansion composition of the disclosure.

In some embodiments of the methods of the disclosure, the T-cell expansion composition comprises, consists essentially of or consists of phosphorus; one or more of an octanoic acid, a palmitic acid, a linoleic acid, and an oleic acid; a sterol; and an alkane.

In certain embodiments of the methods of producing a modified T cell of the disclosure, the expansion supplement comprises one or more cytokine(s). The one or more cytokine(s) may comprise any cytokine, including but not limited to, lymphokines. Exemplary lymphokines include, but are not limited to, interleukin-2 (IL-2), interleukin-3 (IL-3), interleukin-4 (IL-4), interleukin-5 (IL-5), interleukin-6 (IL-6), interleukin-7 (IL-7), interleukin-15 (IL-15), interleukin-21 (IL-21), granulocyte-macrophage colony-stimulating factor (GM-CSF) and interferon-gamma (INFγ). The one or more cytokine(s) may comprise IL-2.

In some embodiments of the methods of the disclosure, the T-cell expansion composition comprises human serum albumin, recombinant human insulin, human transferrin, 2-Mercaptoethanol, and an expansion supplement. In certain embodiments of this method, the T-cell expansion composition further comprises one or more of octanoic acid, nicotinamide, 2,4,7,9-tetramethyl-5-decyn-4,7-diol (TMDD), diisopropyl adipate (DIPA), n-butyl-benzenesulfonamide, 1,2-benzenedicarboxylic acid, bis(2-methylpropyl) ester, palmitic acid, linoleic acid, oleic acid, stearic acid hydrazide, oleamide, a sterol and an alkane. In certain embodiments of this method, the T-cell expansion composition further comprises one or more of octanoic acid, palmitic acid, linoleic acid, oleic acid and a sterol. In certain embodiments of this method, the T-cell expansion composition further comprises one or more of octanoic acid at a concentration of between 0.9 mg/kg to 90 mg/kg, inclusive of the endpoints; palmitic acid at a concentration of between 0.2 mg/kg to 20 mg/kg, inclusive of the endpoints; linoleic acid at a concentration of between 0.2 mg/kg to 20 mg/kg, inclusive of the endpoints; oleic acid at a concentration of 0.2 mg/kg to 20 mg/kg, inclusive of the endpoints; and a sterol at a concentration of about 0.1 mg/kg to 10 mg/kg, inclusive of the endpoints. In certain embodiments of this method, the T-cell expansion composition further comprises one or more of octanoic acid at a concentration of about 9 mg/kg, palmitic acid at a concentration of about 2 mg/kg, linoleic acid at a concentration of about 2 mg/kg, oleic acid at a concentration of about 2 mg/kg and a sterol at a concentration of about 1 mg/kg. In certain embodiments of this method, the T-cell expansion composition further comprises one or more of octanoic acid at a concentration of between 6.4 µmol/kg and 640 µmol/kg, inclusive of the endpoints; palmitic acid at a concentration of between 0.7 µmol/kg and 70 µmol/kg, inclusive of the endpoints; linoleic acid at a concentration of between 0.75 µmol/kg and 75 µmol/kg, inclusive of the endpoints; oleic acid at a concentration of between 0.75 µmol/kg and 75 µmol/kg, inclusive of the endpoints; and a sterol at a concentration of between 0.25 µmol/kg and 25 µmol/kg, inclusive of the endpoints. In certain embodiments of this method, the T-cell expansion composition further comprises one or more of octanoic acid at a concentration of about 64 µmol/kg, palmitic acid at a concentration of about 7 µmol/kg, linoleic acid at a concentration of about 7.5 µmol/kg, oleic acid at a concentration of about 7.5 µmol/kg and a sterol at a concentration of about 2.5 µmol/kg.

In certain embodiments, the T-cell expansion composition comprises one or more of human serum albumin, recombinant human insulin, human transferrin, 2-Mercaptoethanol, and an expansion supplement to produce a plurality of expanded modified T-cells, wherein at least 2% of the plurality of modified T-cells expresses one or more cell-surface marker(s) of an early memory T cell, a stem cell-like T cell, a stem memory T cell ($T_{SCM}$) and/or a central memory T cell ($T_{CM}$). In certain embodiments, the T-cell expansion composition comprises or further comprises one or more of octanoic acid, nicotinamide, 2,4,7,9-tetramethyl-5-decyn-4,7-diol (TMDD), diisopropyl adipate (DIPA), n-butyl-benzenesulfonamide, 1,2-benzenedicarboxylic acid, bis(2-methylpropyl) ester, palmitic acid, linoleic acid, oleic acid, stearic acid hydrazide, oleamide, a sterol and an alkane. In certain embodiments, the T-cell expansion composition comprises one or more of octanoic acid, palmitic acid, linoleic acid, oleic acid and a sterol (e.g. cholesterol). In certain embodiments, the T-cell expansion composition comprises one or more of octanoic acid at a concentration of between 0.9 mg/kg to 90 mg/kg, inclusive of the endpoints; palmitic acid at a concentration of between 0.2 mg/kg to 20 mg/kg, inclusive of the endpoints; linoleic acid at a concentration of between 0.2 mg/kg to 20 mg/kg, inclusive of the endpoints; oleic acid at a concentration of 0.2 mg/kg to 20 mg/kg, inclusive of the endpoints; and a sterol at a concentration of about 0.1 mg/kg to 10 mg/kg, inclusive of the endpoints (wherein mg/kg=parts per million). In certain embodiments, the T-cell expansion composition comprises one or more of octanoic acid at a concentration of about 9 mg/kg, palmitic acid at a concentration of about 2 mg/kg, linoleic acid at a concentration of about 2 mg/kg, oleic acid at a concentration of about 2 mg/kg, and a sterol at a concentration of about 1 mg/kg (wherein mg/kg=parts per million). In certain embodiments, the T-cell expansion composition comprises one or more of octanoic acid at a concentration of 9.19 mg/kg, palmitic acid at a concentration of 1.86 mg/kg, linoleic acid at a concentration of about 2.12 mg/kg, oleic acid at a concentration of about 2.13 mg/kg, and a sterol at a concentration of about 1.01 mg/kg (wherein mg/kg=parts per million). In certain embodiments, the T-cell expansion composition comprises octanoic acid at a concentration of 9.19 mg/kg, palmitic acid at a concentration of 1.86 mg/kg, linoleic acid at a concentration of 2.12 mg/kg, oleic acid at a concentration of about 2.13 mg/kg, and a sterol at a concentration of 1.01 mg/kg (wherein mg/kg=parts per million). In certain embodiments, the T-cell expansion composition comprises one or more of octanoic acid at a concentration of between 6.4 µmol/kg and 640 µmol/kg, inclusive of the endpoints; palmitic acid at a concentration of between 0.7 µmol/kg and 70 µmol/kg, inclusive of the endpoints; linoleic acid at a concentration of between 0.75 µmol/kg and 75 µmol/kg, inclusive of the endpoints; oleic acid at a concentration of between 0.75 µmol/kg and 75 µmol/kg, inclusive of the endpoints; and a sterol at a concentration of between 0.25 µmol/kg and 25 µmol/kg, inclusive of the endpoints. In certain embodiments, the T-cell expansion composition comprises one or more of octanoic acid at a concentration of about 64 µmol/kg, palmitic acid at a concentration of about 7 µmol/kg, linoleic acid at a concentration of about 7.5 µmol/kg, oleic acid at a concentration of about 7.5 µmol/kg and a sterol at a concentration of about 2.5 µmol/kg. In certain embodiments, the T-cell expansion composition comprises one or more of octanoic acid at a concentration of about 63.75 µmol/kg, palmitic acid at a concentration of about 7.27 µmol/kg, linoleic acid at a concentration of about 7.57 µmol/kg, oleic acid at a concentration of about 7.56 µmol/kg and a sterol at a concentration of about 2.61 µmol/kg. In certain embodiments, the T-cell expansion composition comprises octanoic acid at a concentration of about 63.75 µmol/kg, palmitic acid at a concentration of about 7.27 µmol/kg, linoleic acid at a concentration of about 7.57 µmol/cg, oleic acid at a concentration of 7.56 µmol/kg and a sterol at a concentration of 2.61 µmol/kg.

As used herein, the terms "supplemented T-cell expansion composition" or "T-cell expansion composition" may be used interchangeably with a media comprising one or more of human serum albumin, recombinant human insulin, human transferrin, 2-Mercaptoethanol, and an expansion supplement at 37° C. Alternatively, or in addition, the terms "supplemented T-cell expansion composition" or "T-cell expansion composition" may be used interchangeably with a media comprising one or more of phosphorus, an octanoic fatty acid, a palmitic fatty acid, a linoleic fatty acid and an oleic acid. In certain embodiments, the media comprises an amount of phosphorus that is 10-fold higher than may be found in, for example, Iscove's Modified Dulbecco's Medium (IMDM); available at ThermoFisher Scientific as Catalog number 12440053).

As used herein, the terms "supplemented T-cell expansion composition" or "T-cell expansion composition" may be used interchangeably with a media comprising one or more of human serum albumin, recombinant human insulin, human transferrin, 2-Mercaptoethanol. Iscove's MDM, and an expansion supplement at 37° C. Alternatively, or in addition, the terms "supplemented T-cell expansion composition" or "T-cell expansion composition" may be used interchangeably with a media comprising one or more of the following elements: boron, sodium, magnesium, phosphorus, potassium, and calcium. In certain embodiments, the terms "supplemented T-cell expansion composition" or "T-cell expansion composition" may be used interchangeably with a media comprising one or more of the following elements present in the corresponding average concentrations: boron at 3.7 mg/L, sodium at 3000 mg/L, magnesium at 18 mg/L, phosphorus at 29 mg/L, potassium at 15 mg/L and calcium at 4 mg/L.

As used herein, the terms "supplemented T-cell expansion composition" or "T-cell expansion composition" may be used interchangeably with a media comprising one or more of human serum albumin, recombinant human insulin, human transferrin, 2-Mercaptoethanol, and an expansion supplement at 37° C. Alternatively, or in addition, the terms "supplemented T-cell expansion composition" or "T-cell expansion composition" may be used interchangeably with a media comprising one or more of the following components: octanoic acid (CAS No. 124-07-2), nicotinamide (CAS No. 98-92-0), 2,4,7,9-tetramethyl-5-decyn-4,7-diol (TMDD) (CAS No. 126-86-3), diisopropyl adipate (DIPA) (CAS No. 6938-94-9), n-butyl-benzenesulfonamide (CAS No. 3622-84-2), 1,2-benzenedicarboxylic acid, bis(2-methylpropyl) ester (CAS No. 84-69-5), palmitic acid (CAS No. 57-10-3), linoleic acid (CAS No. 60-33-3), oleic acid (CAS No. 112-80-1), stearic acid hydrazide (CAS No. 4130-54-5), oleamide (CAS No. 3322-62-1), sterol (e.g., cholesterol) (CAS No. 57-88-5), and alkanes (e.g., nonadecane) (CAS No. 629-92-5) In certain embodiments, the terms "supplemented T-cell expansion composition" or "T-cell expansion composition" may be used interchangeably with a media comprising one or more of the following components: octanoic acid (CAS No. 124-07-2), nicotinamide (CAS No. 98-92-0), 2,4,79-tetramethyl-5-decyn-4,7-diol (TMDD) (CAS No. 126-86-3), diisopropyl adipate (DIPA) (CAS No. 6938-94-9), n-butyl-benzenesulfonamide (CAS No. 3622-84-2), 1,2-benzenedicarboxylic acid, bis(2-methylpropyl) ester (CAS No. 84-69-5), palmitic acid (CAS No. 57-10-3), linoleic acid (CAS No. 60-33-3), oleic acid (CAS No. 112-80-1), stearic acid hydrazide (CAS No. 4130-54-5), oleamide (CAS No 3322-62-1), sterol (e.g., cholesterol) (CAS No. 57-88-5), alkanes (e.g., nonadecane) (CAS No. 629-92-5), and phenol red (CAS No. 143-74-8). In certain embodiments, the terms "supplemented T-cell expansion composition" or "T-cell expansion composition" may be used interchangeably with a media comprising one or more of the following components: octanoic acid (CAS No. 124-07-2), nicotinamide (CAS No. 98-92-0), 2,4,7,9-tetramethyl-5-decyn-4,7-diol (TMDD) (CAS No. 126-86-3), diisopropyl adipate (DIPA) (CAS No. 6938-94-9), n-butyl-benzenesulfonamide (CAS No. 3622-84-2), 1,2-benzenedicarboxylic acid, bis(2-methylpropyl) ester (CAS No. 84-69-5), palmitic acid (CAS No. 57-10-3), linoleic acid (CAS No. 60-33-3), oleic acid (CAS No. 112-80-1), stearic acid hydrazide (CAS No. 4130-54-5), oleamide (CAS No. 3322-62-1), phenol red (CAS No. 143-74-8) and lanolin alcohol.

In certain embodiments, the terms "supplemented T-cell expansion composition" or "T-cell expansion composition" may be used interchangeably with a media comprising one or more of human serum albumin, recombinant human insulin, human transferrin, 2-Mercaptoethanol, and an expansion supplement at 37° C. Alternatively, or in addition, the terms "supplemented T-cell expansion composition" or "T-cell expansion composition" may be used interchangeably with a media comprising one or more of the following ions: sodium, ammonium, potassium, magnesium, calcium, chloride, sulfate and phosphate.

As used herein, the terms "supplemented T-cell expansion composition" or "T-cell expansion composition" may be used interchangeably with a media comprising one or more of human serum albumin, recombinant human insulin, human transferrin, 2-Mercaptoethanol, and an expansion supplement at 37° C. Alternatively, or in addition, the terms "supplemented T-cell expansion composition" or "T-cell expansion composition" may be used interchangeably with a media comprising one or more of the following free amino acids, histidine, asparagine, serine, glutamate, arginine, glycine, aspartic acid, glutamic acid, threonine, alanine, proline, cysteine, lysine, tyrosine, methionine, valine, isoleucine, leucine, phenylalanine and tryptophan. In certain embodiments, the terms "supplemented T-cell expansion composition" or "T-cell expansion composition" may be used interchangeably with a media comprising one or more of the following free amino acids in the corresponding average mole percentages: histidine (about 1%), asparagine (about 0.5%), serine (about 1.5%), glutamine (about 67%), arginine (about 1.5%), glycine (about 1.5%), aspartic acid (about 1%), glutamic acid (about 2%), threonine (about 2%), alanine (about 1%), proline (about 1.5%), cysteine (about 1.5%), lysine (about 3%), tyrosine (about 1.5%), methionine (about 1%), valine (about 3.5%), isoleucine (about 3%), leucine (about 3.5%), phenylalanine (about 1.5%) and tryptophan (about 0.5%). In certain embodiments, the terms "supplemented T-cell expansion composition" or "T-cell expansion composition" may be used interchangeably with a media comprising one or more of the following free amino acids in the corresponding average mole percentages: histidine (about 0.78%), asparagine (about 0.4%), serine (about 1.6%), glutamine (about 67.01%), arginine (about 1.67%), glycine (about 1.72%), aspartic acid (about 1.00%), glutamic acid (about 1.93%), threonine (about 2.38%), alanine (about 1.11%), proline (about 1.49%), cysteine (about 1.65%), lysine (about 2.84%), tyrosine (about 1.62%), methionine (about 0.85%), valine (about 3.45%), isoleucine (about 3.14%), leucine (about 3.3%), phenylalanine (about 1.64%) and tryptophan (about 0.37%).

As used herein, the terms "supplemented T-cell expansion composition" or "T-cell expansion composition" may be used interchangeably with a media comprising one or more of human serum albumin, recombinant human insulin, human transferrin, 2-Mercaptoethanol, Iscove's MDM, and an expansion supplement at 37° C. Alternatively, or in addition, the terms "supplemented T-cell expansion composition" or "T-cell expansion composition" may be used interchangeably with a media comprising one or more of phosphorus, an octanoic fatty acid, a palmitic fatty acid, a linoleic fatty acid and an oleic acid. In certain embodiments, the media comprises an amount of phosphorus that is 10-fold higher than may be found in, for example, Iscove's Modified Dulbecco's Medium ((IMDM); available at ThermoFisher Scientific as Catalog number 12440053).

In certain embodiments, the terms "supplemented T-cell expansion composition" or "T-cell expansion composition" may be used interchangeably with a media comprising one or more of octanoic acid, palmitic acid, linoleic acid, oleic acid and a sterol (e.g. cholesterol). In certain embodiments, the terms "supplemented T-cell expansion composition" or "T-cell expansion composition" may be used interchangeably with a media comprising one or more of octanoic acid at a concentration of between 0.9 mg/kg to 90 mg/kg, inclusive of the endpoints; palmitic acid at a concentration of between 0.2 mg/kg to 20 mg/kg, inclusive of the endpoints; linoleic acid at a concentration of between 0.2 mg/kg to 20 mg/kg, inclusive of the endpoints; oleic acid at a concentration of 0.2 mg/kg to 20 mg/kg, inclusive of the endpoints; and a sterol at a concentration of about 0.1 mg/kg to 10 mg/kg, inclusive of the endpoints (wherein mg/kg=parts per million). In certain embodiments, the terms "supplemented T-cell expansion composition" or "T-cell expansion composition" may be used interchangeably with a media comprising one or more of octanoic acid at a concentration of about 9 mg/kg, palmitic acid at a concentration of about 2 mg/kg, linoleic acid at a concentration of about 2 mg/kg, oleic acid at a concentration of about 2 mg/kg, and a sterol at a concentration of about 1 mg/kg (wherein mg/kg=parts per million). In certain embodiments, the terms "supplemented T-cell expansion composition" or "T-cell expansion composition" may be used interchangeably with a media comprising one or more of octanoic acid at a concentration of 9.19 mg/kg, palmitic acid at a concentration of 1.86 mg/kg, linoleic acid at a concentration of about 2.12 mg/kg, oleic acid at a concentration of about 2.13 mg/kg, and a sterol at a concentration of about 1.01 mg/kg (wherein mg/kg=parts per million). In certain embodiments, the terms "supplemented T-cell expansion composition" or "T-cell expansion composition" may be used interchangeably with a media comprising one or more of octanoic acid at a concentration of 9.19 mg/kg, palmitic acid at a concentration of 1.86 mg/kg, linoleic acid at a concentration of 2.12 mg/kg, oleic acid at a concentration of about 2.13 mg/kg, and a sterol at a concentration of 1.01 mg/kg (wherein mg/kg=parts per million). In certain embodiments, the terms "supplemented T-cell expansion composition" or "T-cell expansion composition" may be used interchangeably with a media comprising one or more of octanoic acid at a concentration of between 6.4 µmol/kg and 640 µmol/kg, inclusive of the endpoints; palmitic acid at a concentration of between 0.7 µmol/kg and 70 µmol/kg, inclusive of the endpoints; linoleic acid at a concentration of between 0.75 µmol/kg and 75 µmol/kg, inclusive of the endpoints; oleic acid at a concentration of between 0.75 µmol/kg and 75 µmol/kg, inclusive of the endpoints; and a sterol at a concentration of between 0.25 µmol/kg and 25 µmol/kg, inclusive of the endpoints. In certain embodiments, the terms "supplemented T-cell expansion composition" or "T-cell expansion composition" may be used interchangeably with a media comprising one or more of octanoic acid at a concentration of about 64 µmol/kg, palmitic acid at a concentration of about 7 µmol/kg, linoleic acid at a concentration of about 7.5 µmol/kg, oleic acid at a concentration of about 7.5 µmol/kg and a sterol at a concentration of about 2.5 µmol/kg.

In certain embodiments, the terms "supplemented T-cell expansion composition" or "T-cell expansion composition" may be used interchangeably with a media comprising one or more of octanoic acid at a concentration of about 63.75 µmol/kg, palmitic acid at a concentration of about 7.27 µmol/kg, linoleic acid at a concentration of about 7.57 µmol/kg, oleic acid at a concentration of about 7.56 µmol/kg and a sterol at a concentration of about 2.61 µmol/kg. In certain embodiments, the terms "supplemented T-cell expansion composition" or "T-cell expansion composition" may be used interchangeably with a media comprising one or more of octanoic acid at a concentration of about 63.75 µmol/kg, palmitic acid at a concentration of about 7.27 µmol/kg, linoleic acid at a concentration of about 7.57 µmol/kg, oleic acid at a concentration of about 7.56 µmol/kg and a sterol at a concentration of about 2.61 µmol/kg.

In certain embodiments of the methods of producing a modified T cell (e.g. a stem cell-like T cell, a $T_{SCM}$ and/or a $T_{CM}$) of the disclosure, the method comprises contacting a modified T cell and an inhibitor of the PI3K-Akt-mTOR pathway. Modified T-cells of the disclosure, including modified stem cell-like T cells, $T_{SCM}$ and/or $T_{CM}$ of the disclosure, may be incubated, cultured, grown, stored, or otherwise, combined at any step in the methods of the procedure with a growth medium comprising one or more inhibitors a component of a PI3K pathway. Exemplary inhibitors a component of a PI3K pathway include, but are not limited to, an inhibitor of GSK30 such as TWS119 (also known as GSK 3B inhibitor XII; CAS Number 601514-19-6 having a chemical formula $C_{18}H_{14}N_4O_2$). Exemplary inhibitors of a component of a PI3K pathway include, but are not limited to, bb007 (BLUEBIRDBIO™). Additional Exemplary inhibitors of a component of a PI3K pathway include, but are not limited to, an allosteric Akt inhibitor VIII (also referred to as Akti-1/2 having Compound number 10196499), ATP competitive inhibitors (Orthosteric inhibitors targeting the ATP-binding pocket of the protein kinase B (Akt)), Isoquinoline-5-sulfonamides (H-8, H-89, and NL-71-101), Azepane derivatives (A series of structures derived from (−)-balanol), Aminofurazans (GSK690693). Heterocyclic rings (7-azaindole, 6-phenylpurine derivatives, pyrrolo[2,3-d]pyrimidine derivatives, CCT128930, 3-aminopyrrolidine, anilinotriazole derivatives, spiroindoline derivatives, AZD5363, ipatasertib (GDC-0068. RG7440), A-674563, and A-443654). Phenylpyrazole derivatives (AT7867 and AT13148), Thiophenecarboxamide derivatives (Afuresertib (GSK2110183), 2-pyrimidyl-5-amidothiophene derivative (DC120), uprosertib (GSK2141795)), Allosteric inhibitors (Superior to orthosteric inhibitors providing greater specificity, reduced side-effects and less toxicity). 2,3-diphenylquinoxaline analogues (2,3-diphenylquinoxaline derivatives, triazolo[3,4-f][1,6]naphthyridin-3 (2H)-one derivative (MK-2206)), Alkylphospholipids (Edelfosine (1-O-octadecyl-2-O-methyl-rac-glycero-3-phosphocholine, ET-8-OCH$_3$) ilmofosine (BM 41.440), miltefosine (hexadecylphosphocholine, HePC), perifosine (D-21266), erucylphosphocholine (ErPC), erufosine (ErPC3, erucylphosphohomocholine), Indole-3-carbinol analogues (Indole-3-carbinol, 3-chloroacetylindole, diindolylmethane, diethyl 6-methoxy-5,7-dihydroindolo [2,3-b] carbazole-2,10-dicarboxylate (SR13668), OSU-A9), Sulfonamide derivatives (PH-316 and PHT-427), Thiourea derivatives (PIT-1, PIT-2, DM-PIT-1, N-[(1-methyl-1H-pyrazol-4-yl)carbonyl]-N'-(3-bromophenyl)-thiourea), Purine derivatives (Triciribine (TCN, NSC 154020), triciribine mono-phosphate active analogue (TCN-P), 4-aminopyrido[2,3-d]pyrimidine derivative API-1, 3-phenyl-3H-imidazo[4,5-b]pyridine derivatives, ARQ 092). BAY 1125976, 3-methyl-xanthine, quinoline-4-carboxamide and 2-[4-(cyclohexa-1,3-dien-1-yl)-1H-pyrazol-3-yl]phenol, 3-oxo-tirucallic acid, 3α- and 3β-acetoxy-tirucallic acids, acetoxy-tirucallic acid, and irreversible inhibitors (antibiotics, Lactoquinomycin, Frenolicin B, kalafungin, medermycin, Boc-Phe-vinyl ketone, 4-hydroxynonenal (4-HNE), 1,6-naphthyridinone derivatives, and imidazo-1,2-pyridine derivatives).

In certain embodiments of the methods of producing a modified T cell (e.g. a stem cell-like T cell, a $T_{SCM}$ and/or a $T_{CM}$) of the disclosure, the method comprises contacting a modified T cell and an inhibitor of T cell effector differentiation. Exemplary inhibitors of T cell effector differentiation include, but are not limited to, a BET inhibitor (e.g. JQ1, a hienotriazolodiazepine) and/or an inhibitor of the BET family of proteins (e.g. BRD2, BRD3, BRD4, and BRDT).

In certain embodiments of the methods of producing a modified T cell (e.g. a stem cell-like T cell, a $T_{SCM}$ and/or a $T_{CM}$) of the disclosure, the method comprises contacting a modified T cell and an agent that reduces nucleo-cytoplasmic Acetyl-CoA. Exemplary agents that reduce nucleo-cytoplasmic Acetyl-CoA include, but are not limited to, 2-hydroxy-citrate (2-HC) as well as agents that increase expression of Acss1.

In certain embodiments of the methods of producing a modified T cell (e.g. a stem cell-like T cell, a TSCM and/or a TCM) of the disclosure, the method comprises contacting a modified T cell and a composition comprising a histone deacetylase (HDAC) inhibitor. In some embodiments, the composition comprising an HDAC inhibitor comprises or consists of valproic acid, Sodium Phenylbutyrate (NaPB) or a combination thereof. In some embodiments, the composition comprising an HDAC inhibitor comprises or consists of valproic acid. In some embodiments, the composition comprising an HDAC inhibitor comprises or consists of Sodium Phenylbutyrate (NaPB).

In certain embodiments of the methods of producing a modified T cell (e.g. a stem cell-like T cell, a $T_{SCM}$ and/or a $T_{CM}$) of the disclosure, the activation supplement may comprise one or more cytokine(s). The one or more cytokine(s) may comprise any cytokine, including but not limited to, lymphokines. Exemplary lymphokines include, but are not limited to, interleukin-2 (IL-2), interleukin-3 (IL-3), interleukin-4 (IL-4), interleukin-5 (IL-5), interleukin-6 (IL-6), interleukin-7 (IL-7), interleukin-15 (IL-15), interleukin-21 (IL-21), granulocyte-macrophage colony-stimulating factor (GM-CSF) and interferon-gamma (INFγ). The one or more cytokine(s) may comprise IL-2.

In certain embodiments of the methods of producing a modified T cell (e.g. a stem cell-like T cell, a $T_{SCM}$ and/or a $T_{CM}$) of the disclosure, the activation supplement may comprise one or more activator complexes. Exemplary and nonlimiting activator complexes may comprise a monomeric, dimeric, trimeric or tetrameric antibody complex that binds one or more of CD3, CD28, and CD2. In some embodiments, the activation supplement comprises or consists of an activator complex that comprises a human, a humanized or a recombinant or a chimeric antibody. In some embodiments, the activation supplement comprises or consists of an activator complex that binds CD3 and CD28. In some embodiments, the activation supplement comprises or consists of an activator complex that binds CD3, CD28 and CD2.

Natural Killer (NK) Cells

In certain embodiments, the modified immune or immune precursor cells of the disclosure are natural killer (NK) cells. In certain embodiments, NK cells are cytotoxic lymphocytes that differentiate from lymphoid progenitor cells.

Modified NK cells of the disclosure may be derived from modified hematopoietic stem and progenitor cells (HSPCs) or modified HSCs.

In certain embodiments, non-activated NK cells are derived from CD3-depleted leukopheresis (containing CD14/CD19/CD56+ cells).

In certain embodiments, NK cells are electroporated using a Lonza 4D nucleofector or BTX ECM 830 (500V, 700 usec pulse length, 0.2 mm electrode gap, one pulse). All Lonza 4D nucleofector programs are contemplated as within the scope of the methods of the disclosure.

In certain embodiments, 5×10E6 cells were electroporated per electroporation in 100 μL P3 buffer in cuvettes. However, this ratio of cells per volume is scalable for commercial manufacturing methods.

In certain embodiments, NK cells were stimulated by co-culture with an additional cell line. In certain embodiments, the additional cell line comprises artificial antigen presenting cells (aAPCs). In certain embodiments, stimulation occurs at day 1, 2, 3, 4, 5, 6, or 7 following electroporation. In certain embodiments, stimulation occurs at day 2 following electroporation.

In certain embodiments, NK cells express CD56.

B Cells

In certain embodiments, the modified immune or immune precursor cells of the disclosure are B cells. B cells are a type of lymphocyte that express B cell receptors on the cell surface. B cell receptors bind to specific antigens.

Modified B cells of the disclosure may be derived from modified hematopoietic stem and progenitor cells (HSPCs) or modified HSCs.

In certain embodiments, HSPCs are modified using the methods of the disclosure, and then primed for B cell differentiation in presence of human IL-3, Flt3L, TPO, SCF, and G-CSF for at least 3 days, at least 4 days, at least 5 days, at least 6 days or at least 7 days. In certain embodiments. HSPCs are modified using the methods of the disclosure, and then primed for B cell differentiation in presence of human IL-3, Flt3L, TPO, SCF, and G-CSF for 5 days.

In certain embodiments, following priming, modified HSPC cells are transferred to a layer of feeder cells and fed bi-weekly, along with transfer to a fresh layer of feeders once per week. In certain embodiments, the feeder cells are MS-5 feeder cells.

In certain embodiments, modified HSPC cells are cultured with MS-5 feeder cells for at least 7, 14, 21, 28, 30, 33, 35, 42 or 48 days. In certain embodiments, modified HSPC cells are cultured with MS-5 feeder cells for 33 days.

Methods of Cell Modification

In some embodiments of the methods of the disclosure, a composition comprises a scalable ratio of 250×10⁶ primary human T cells per milliliter of buffer or other media during a delivery or an introduction step.

In some embodiments of the methods of the disclosure, a composition is delivered or introduced to a cell by electroporation or nucleofection. In some embodiments, a delivery or introduction step comprises electroporation or nucleofection.

In some embodiments of the methods of the disclosure, a composition is delivered or introduced to a cell by a method other than electroporation or nucleofection.

In some embodiments of the methods of the disclosure, a composition is delivered or introduced by one or more of topical delivery, adsorption, absorption, electroporation, spin-fection, co-culture, transfection, mechanical delivery, sonic delivery, vibrational delivery, magnetofection or by nanoparticle-mediated delivery. In some embodiments, a delivery or introduction step comprises one or more of topical delivery, adsorption, absorption, electroporation, spin-fection, co-culture, transfection, mechanical delivery, sonic delivery, vibrational delivery, magnetofection or by nanoparticle-mediated delivery.

In some embodiments of the methods of the disclosure, a composition is delivered or introduced by liposomal transfection, calcium phosphate transfection, fugene transfection, and dendrimer-mediated transfection. In some embodiments, a delivery or introduction step comprises one or more of liposomal transfection, calcium phosphate transfection, fugene transfection, and dendrimer-mediated transfection.

In some embodiments of the methods of the disclosure, a composition is delivered or introduced by mechanical transfection comprises cell squeezing, cell bombardment, or gene gun techniques. In some embodiments, a delivery or introduction step comprises one or more of mechanical transfection comprises cell squeezing, cell bombardment, or gene gun techniques.

In some embodiments of the methods of the disclosure, a composition is delivered or introduced by nanoparticle-mediated transfection comprises liposomal delivery, delivery by micelles, and delivery by polymerosomes. In some embodiments, a delivery or introduction step comprises one or more of liposomal delivery, delivery by micelles, and delivery by polymerosomes.

Non-Transposition Methods of Delivery

In some embodiments of the compositions and methods of the disclosure, a modified cell of the disclosure may be produced by introducing a sequence into an HSC, an HSC descendent cell, an immune cell or an immune precursor cell of the disclosure. The introducing step may comprise delivery of a sequence and/or a gene editing composition via a non-transposition delivery system. The introduction step may be performed ex vivo, in vivo, in vitro or in situ.

In some embodiments of the compositions and methods of the disclosure, introducing a sequence and/or a gene editing composition into an HSC, an HSC descendent cell, an immune cell or an immune precursor cell of the disclosure comprises one or more of topical delivery, adsorption, absorption, electroporation, spin-fection, co-culture, transfection, mechanical delivery, sonic delivery, vibrational delivery, magnetofection and nanoparticle-mediated delivery.

In some embodiments of the compositions and methods of the disclosure, introducing a nucleic acid sequence and/or a gene editing construct into an HSC, an HSC descendent cell, an immune cell or an immune precursor cell of the disclosure comprises liposomal transfection, calcium phosphate transfection, fugene transfection, and dendrimer-mediated transfection.

In some embodiments of the compositions and methods of the disclosure, introducing a sequence and/or a gene editing composition into an HSC, an HSC descendent cell, an immune cell or an immune precursor cell of the disclosure by mechanical transfection comprises cell squeezing, cell bombardment, or gene gun techniques.

In some embodiments of the compositions and methods of the disclosure, introducing a sequence and/or a gene editing composition into an HSC, an HSC descendent cell, an immune cell or an immune precursor cell of the disclosure by nanoparticle-mediated transfection comprises one or more of a liposome, a micelle, a polymer and a polymerosome.

In some embodiments of the compositions and methods of the disclosure, introducing a sequence and/or a gene editing composition into an HSC, an HSC descendent cell, an immune cell or an immune precursor cell of the disclosure comprises a non-viral vector. In some embodiments, the non-viral vector comprises the sequence and/or the gene editing composition. In some embodiments, the non-viral vector comprises plasmid DNA, linear double-stranded DNA (dsDNA), linear single-stranded DNA (ssDNA). DoggyBone™ DNA, nanoplasmids, minicircle DNA, single-stranded oligodeoxynucleotides (ssODN), DDNA oligonucleotides, single-stranded mRNA (ssRNA), and double-stranded mRNA (dsRNA).

In some embodiments of the compositions and methods of the disclosure, introducing a sequence and/or a gene editing composition into an HSC, an HSC descendent cell, an immune cell or an immune precursor cell of the disclosure comprises a viral vector. In some embodiments, the viral vector is a non-integrating and/or non-chromosomal vector. Exemplary non-integrating non-chromosomal vectors include, but are not limited to, adeno-associated virus (AAV), adenovirus, and herpes viruses. In some embodiments, the viral vector is an integrating chromosomal vector. Integrating chromosomal vectors include, but are not limited to, adeno-associated vectors (AAV), Lentiviruses, and gamma-retroviruses. In some embodiments, the viral vector comprises the sequence and/or the gene editing composition.

In some embodiments of the compositions and methods of the disclosure, introducing a sequence and/or a gene editing composition into an HSC, an HSC descendent cell, an immune cell or an immune precursor cell of the disclosure comprises a combination of vectors of the disclosure. Exemplary, non-limiting vector combinations include: viral and non-viral vectors, a plurality of non-viral vectors, or a plurality of viral vectors. Exemplary but non-limiting vectors combinations include: a combination of a DNA-derived and an RNA-derived vector, a combination of non-viral expression vector and a viral delivery vector, a combination of a non-viral expression vector and a nanoparticle delivery vector, a combination of two distinct non-viral expression vectors, a combination of a non-viral expression vector and a mechanical or chemical method of transfection.

In some embodiments of the compositions and methods of the disclosure, introducing a sequence and/or a gene editing composition into an HSC, an HSC descendent cell, an immune cell or an immune precursor cell of the disclosure stably integrates a sequence, transiently integrates a sequence, produces site-specific integration of a sequence, or produces a biased integration of a sequence. In some embodiments, the sequence is a nucleic acid sequence. In some embodiments, the nucleic acid sequence comprises a transgene.

In some embodiments of the compositions and methods of the disclosure, introducing a sequence and/or a gene editing composition into an HSC, an HSC descendent cell, an immune cell or an immune precursor cell of the disclosure stably integrates a sequence. In some embodiments, the sequence is a nucleic acid sequence. In some embodiments, the stable chromosomal integration can be a random integration, a site-specific integration, or a biased integration. In some embodiments, the site-specific integration can be non-assisted or assisted. In some embodiments, the assisted site-specific integration is co-delivered with a site-directed nuclease. In some embodiments, the site-directed nuclease comprises a transgene with 5' and 3' nucleotide sequence extensions that contain a percentage homology to upstream and downstream regions of the site of genomic integration. In some embodiments, the transgene with homologous nucleotide extensions enable genomic integration by homologous recombination, microhomology-mediated end joining, or nonhomologous end-joining. In some embodiments the site-specific integration occurs at a safe harbor site. Genomic safe harbor sites are able to accommodate the integration of new genetic material in a manner that ensures that the newly inserted genetic elements function reliably (for example, are expressed at a therapeutically effective level of expression) and do not cause deleterious alterations to the host genome that cause a risk to the host organism. Potential genomic safe harbors include, but are not limited to, intronic sequences of the human albumin gene, the adeno-associated virus site 1 (AAVS1), a naturally occurring site of integration of AAV virus on chromosome 19, the site of the chemokine (C-C motif) receptor 5 (CCR5) gene and the site of the human ortholog of the mouse Rosa26 locus.

In some embodiments, the site-specific transgene integration occurs at a site that disrupts expression of a target gene.

In some embodiments, disruption of target gene expression occurs by site-specific integration at introns, exons, promoters, genetic elements, enhancers, suppressors, start codons, stop codons, and response elements. In some embodiments, exemplary target genes targeted by site-specific integration include but are not limited to TRAC, TRAB, PD1, any immunosuppressive gene, and genes involved in allo-rejection.

In some embodiments of the compositions and methods of the disclosure, introducing a sequence and/or a gene editing composition into an HSC, an HSC descendent cell, an immune cell or an immune precursor cell of the disclosure site-specific transgene integration occurs at a site that results in enhanced expression of a target gene. In some embodiments, enhancement of target gene expression occurs by site-specific integration at introns, exons, promoters, genetic elements, enhancers, suppressors, start codons, stop codons, and response elements.

In some embodiments of the compositions and methods of the disclosure, introducing a sequence and/or a gene editing composition into an HSC, an HSC descendent cell, an immune cell or an immune precursor cell of the disclosure enzymes may be used to create strand breaks in the host genome to facilitate delivery or integration of the transgene. In some embodiments, enzymes create single-strand breaks. In some embodiments, enzymes create double-strand breaks. In some embodiments, examples of break-inducing enzymes include but are not limited to: transposases, integrases, endonucleases, CRISPR-Cas9, transcription activator-like effector nucleases (TALEN), zinc finger nucleases (ZFN), Cas-CLOVER™, and CPF1. In some embodiments, break-inducing enzymes can be delivered to the cell encoded in DNA, encoded in mRNA, as a protein, as a nucleoprotein complex with a guide RNA (gRNA).

In some embodiments of the compositions and methods of the disclosure, introducing a sequence and/or a gene editing composition into an HSC, an HSC descendent cell, an immune cell or an immune precursor cell of the disclosure site-specific transgene integration is controlled by a vector-mediated integration site bias. In some embodiments vector-mediated integration site bias is controlled by the chosen lentiviral vector. In some embodiments vector-mediated integration site bias is controlled by the chosen gamma-retroviral vector.

In some embodiments of the compositions and methods of the disclosure, introducing a sequence and/or a gene editing composition into an HSC, an HSC descendent cell, an immune cell or an immune precursor cell of the disclosure site-specific transgene integration site is a non-stable chromosomal insertion. In some embodiments, the integrated transgene may become silenced, removed, excised, or further modified.

In some embodiments of the compositions and methods of the disclosure, introducing a sequence and/or a gene editing composition into an HSC, an HSC descendent cell, an immune cell or an immune precursor cell of the disclosure genome modification comprises a non-stable integration of a transgene. In some embodiments, the non-stable integration can be a transient non-chromosomal integration, a semi-stable non chromosomal integration, a semi-persistent non-chromosomal insertion, or a non-stable chromosomal insertion. In some embodiments, the transient non-chromosomal insertion can be epi-chromosomal or cytoplasmic.

In some embodiments of the compositions and methods of the disclosure, introducing a sequence and/or a gene editing composition into an HSC, an HSC descendent cell, an immune cell or an immune precursor cell of the disclosure the transient non-chromosomal insertion of a transgene does not integrate into a chromosome and the modified genetic material is not replicated during cell division.

In some embodiments of the compositions and methods of the disclosure, introducing a sequence and/or a gene editing composition into an HSC, an HSC descendent cell, an immune cell or an immune precursor cell of the disclosure genome modification comprises a semi-stable or persistent non-chromosomal integration of a transgene. In some embodiments, a DNA vector encodes a Scaffold/matrix attachment region (S-MAR) module that binds to nuclear matrix proteins for episomal retention of a non-viral vector allowing for autonomous replication in the nucleus of dividing cells.

In some embodiments of the compositions and methods of the disclosure, introducing a sequence and/or a gene editing composition into an HSC, an HSC descendent cell, an immune cell or an immune precursor cell of the disclosure genome modification is a non-stable chromosomal integration of a transgene. In some embodiments, the integrated transgene may become silenced, removed, excised, or further modified.

In some embodiments of the compositions and methods of the disclosure, introducing a sequence and/or a gene editing composition into an HSC, an HSC descendent cell, an immune cell or an immune precursor cell of the disclosure modification to the genome by transgene insertion can occur via host cell-directed double-strand breakage repair (homology-directed repair) by homologous recombination (HR), microhomology-mediated end joining (MMEJ), nonhomologous end joining (NHEJ), transposase enzyme-mediated modification, integrase enzyme-mediated modification, endonuclease enzyme-mediated modification, or recombinant enzyme-mediated modification. In some embodiments, the modification to the genome by transgene insertion can occur via CRISPR-Cas9, TALEN, ZFNs, Cas-CLOVER, and cpf1.

Nanoparticle Delivery

In some embodiments of the compositions and methods of the disclosure, introducing a sequence and/or a gene editing composition into an HSC an HSC descendent cell, an immune cell or an immune precursor cell of the disclosure comprise a nanoparticle vector. Nanoparticle vectors may encapsulate a composition of the disclosure. Alternatively, or in addition, a surface of a nanoparticle vector may comprise a composition of the disclosure. In some embodiments, the surface is an interior surface. In some embodiments, the surface is an exterior surface. In some embodiments, the surface comprises a composition of the disclosure integrated therein or thereon.

Nonlimiting examples of nanoparticle vectors of the disclosure may comprise one or more of a hydrophilic block, a hydrophobic block, and a charged block. In some embodiments, the hydrophilic block may be poly(ethylene oxide) (PEO), and the charged block may be poly(L-histidine).

The disclosure provides nanoparticle vectors comprising di-block and tri-block co-polymers. Exemplary di-block co-polymers may comprise one or more of a hydrophilic block, a hydrophobic block, and a charged block. In some embodiments, the hydrophilic block may be poly(ethylene oxide) (PEO), and the charged block may be poly(L-histidine). Exemplary tri-block co-polymers may comprise one or more of a hydrophilic block, a hydrophobic block, and a charged block. In some embodiments, the hydrophilic block may be poly(ethylene oxide) (PEO), and the charged block may be poly(L-histidine).

An exemplary tri-block copolymer that may be used in various embodiments is a PEO-b-PLA-b-PHIS, with variable numbers of repeating units in each block varying by design.

Poly(histidine) (i.e., poly(L-histidine)), is a pH-sensitive polymer due to the imidazole ring providing an electron lone pair on the unsaturated nitrogen. That is, poly(histidine) has amphoteric properties through protonation-deprotonation. The various embodiments enable intracellular delivery of compositions of the disclosure, including gene editing compositions, by, for example, complexing with poly(histidine)-based micelles.

Diblock copolymers that may be used as intermediates for making triblock copolymers of the embodiment micelles may have hydrophilic biocompatible poly(ethylene oxide) (PEO), which is chemically synonymous with PEG, coupled to various hydrophobic aliphatic poly(anhydrides), poly (nucleic acids), poly(esters), poly(ortho esters), poly(peptides), poly(phosphazenes) and poly(saccharides), including but not limited by poly(lactide) (PLA), poly(glycolide) (PLGA), poly(lactic-co-glycolic acid) (PLGA), poly(ε-caprolactone) (PCL), and poly (trimethylene carbonate) (PTMC).

Polymeric micelles comprised of 100% PEGylated surfaces possess improved in vitro chemical stability, augmented in vivo bioavailability, and prolonged blood circulatory half-lives. For example, aliphatic polyesters, constituting the polymeric micelle's membrane portions, are degraded by hydrolysis of their ester linkages in physiological conditions such as in the human body. Because of their biodegradable nature, aliphatic polyesters have received a great deal of attention for use as implantable biomaterials in drug delivery devices, bioresorbable sutures, adhesion barriers, and as scaffolds for injury repair via tissue engineering.

Without wishing to be bound by a particular theory, it is believed that believed that in the micelles that are formed by the various embodiment triblock copolymers, the hydrophobic blocks aggregate to form a core, leaving the hydrophilic blocks and poly(histidine) blocks on the ends to form one or more surrounding layer.

Scaffold Proteins

Protein scaffolds of the disclosure may be derived from a fibronectin type III (FN3) repeat protein, encoding or complementary nucleic acids, vectors, host cells, compositions, combinations, formulations, devices, and methods of making and using them. In a preferred embodiment, the protein scaffold is comprised of a consensus sequence of multiple FN3 domains from human Tenascin-C (hereinafter "Tenascin"). In a further preferred embodiment, the protein scaffold of the present disclosure is a consensus sequence of 15 FN3 domains. The protein scaffolds of the disclosure can be designed to bind various molecules, for example, a cellular target protein. In a preferred embodiment, the protein scaffolds of the disclosure can be designed to bind an epitope of a wild type and/or variant form of a ligand or an antigen.

Protein scaffolds of the disclosure may include additional molecules or moieties, for example, the Fc region of an antibody, albumin binding domain, or other moiety influencing half-life. In further embodiments, the protein scaffolds of the disclosure may be bound to a nucleic acid molecule that may encode the protein scaffold.

The disclosure provides at least one method for expressing at least one protein scaffold based on a consensus sequence of multiple FN3 domains, in a host cell, comprising culturing a host cell as described herein under conditions wherein at least one protein scaffold is expressed in detectable and/or recoverable amounts.

The disclosure provides at least one composition comprising (a) a protein scaffold based on a consensus sequence of multiple FN3 domains and/or encoding nucleic acid as described herein; and (b) a suitable and/or pharmaceutically acceptable carrier or diluent.

The disclosure provides a method of generating libraries of a protein scaffold based on a fibronectin type III (FN3) repeat protein, preferably, a consensus sequence of multiple FN3 domains and, more preferably, a consensus sequence of multiple FN3 domains from human Tenascin. The library is formed by making successive generations of scaffolds by altering (by mutation) the amino acids or the number of amino acids in the molecules in particular positions in portions of the scaffold, e.g., loop regions. Libraries can be generated by altering the amino acid composition of a single loop or the simultaneous alteration of multiple loops or additional positions of the scaffold molecule. The loops that are altered can be lengthened or shortened accordingly. Such libraries can be generated to include all possible amino acids at each position, or a designed subset of amino acids. The library members can be used for screening by display, such as in vitro or CIS display (DNA, RNA, ribosome display, etc.), yeast, bacterial, and phage display.

Protein scaffolds of the disclosure provide enhanced biophysical properties, such as stability under reducing conditions and solubility at high concentrations; they may be expressed and folded in prokaryotic systems, such as E. coli, in eukaryotic systems, such as yeast, and in in vitro transcription/translation systems, such as the rabbit reticulocyte lysate system.

The disclosure provides a method of generating a scaffold molecule that binds to a particular target by panning the scaffold library of the invention with the target and detecting binders. In other related aspects, the disclosure comprises screening methods that may be used to generate or affinity mature protein scaffolds with the desired activity, e.g., capable of binding to target proteins with a certain affinity. Affinity maturation can be accomplished by iterative rounds of mutagenesis and selection using systems, such as phage display or in vitro display. Mutagenesis during this process may be the result of site directed mutagenesis to specific scaffold residues, random mutagenesis due to error-prone PCR, DNA shuffling, and/or a combination of these techniques.

The disclosure provides an isolated, recombinant and/or synthetic protein scaffold based on a consensus sequence of fibronectin type III (FN3) repeat protein, including, without limitation, mammalian-derived scaffold, as well as compositions and encoding nucleic acid molecules comprising at least one polynucleotide encoding protein scaffold based on the consensus FN3 sequence. The disclosure further includes, but is not limited to, methods of making and using such nucleic acids and protein scaffolds, including diagnostic and therapeutic compositions, methods and devices.

The protein scaffolds of the disclosure offer advantages over conventional therapeutics, such as ability to administer locally, orally, or cross the blood-brain barrier, ability to express in E. Coli allowing for increased expression of protein as a function of resources versus mammalian cell expression ability to be engineered into bispecific or tandem molecules that bind to multiple targets or multiple epitopes of the same target, ability to be conjugated to drugs, polymers, and probes, ability to be formulated to high concentrations, and the ability of such molecules to effectively penetrate diseased tissues and tumors.

Moreover, the protein scaffolds possess many of the properties of antibodies in relation to their fold that mimics the variable region of an antibody. This orientation enables the FN3 loops to be exposed similar to antibody complementarity determining regions (CDRs). They should be able to bind to cellular targets and the loops can be altered, e.g., affinity matured, to improve certain binding or related properties.

Three of the six loops of the protein scaffold of the disclosure correspond topologically to the complementarity determining regions (CDRs 1-3), i.e., antigen-binding regions, of an antibody, while the remaining three loops are surface exposed in a manner similar to antibody CDRs. These loops span at or about residues 13-16, 22-28, 38-43, 51-54, 60-64, and 75-81 of the consensus sequence. Preferably, the loop regions at or about residues 22-28, 51-54, and 75-81 are altered for binding specificity and affinity. One or more of these loop regions are randomized with other loop regions and/or other strands maintaining their sequence as backbone portions to populate a library and potent binders can be selected from the library having high affinity for a particular protein target. One or more of the loop regions can interact with a target protein similar to an antibody CDR interaction with the protein.

Discovery of Antigen/Ligand Recognition Region Sequences

The disclosure provides a method of generating libraries of antigen/ligand recognition region (ARR/LRR) sequences for binding antigens and/or ligands of the disclosure. The library is formed by making successive generations of ARR/LRR sequences by altering (by mutation) the amino acids or the number of amino acids in the sequences at particular positions of the ARR/LRR In some embodiments, the ARR/LRR comprises one or more of a protein scaffold, an antibody mimetic, a Centyrin, a single chain antibody (scFv), a single domain antibody, a VHH and a VH of the disclosure. In some embodiments, the library is formed by making successive generations of ARR/LRR sequences by altering (by mutation) the amino acids or the number of amino acids in the sequences at particular positions of an antibody, an ScFv, VHH or VH, e.g., one or more complementarity determining regions (CDR) and/or framework regions of a variable domain.

Libraries can be generated by altering the amino acid composition of a single CDR or the simultaneous alteration of multiple CDRs or additional positions of an antibody, an scFv, VHH or VH (e.g. a framework sequence of the variable region). The CDR and/or framework sequence of the variable domain that are altered can be lengthened or shortened accordingly.

Libraries can be generated by altering the amino acid composition of a loop of a scaffold protein or a Centyrin. The loop sequences that are altered can be lengthened or shortened accordingly.

Libraries can be generated by altering the amino acid composition of an antigen or ligand-binding or specificity-determining region of an antibody mimetic.

Such libraries can be generated to include all possible amino acids at each position, or a designed subset of amino acids. The library members can be used for screening by display, such as in vitro or CIS display (DNA, RNA, ribosome display, etc.), yeast, bacterial, and phage display.

ARRs/LRRs of the disclosure provide enhanced biophysical properties, such as stability under reducing conditions and solubility at high concentrations; they may be expressed and folded in prokaryotic systems, such as E. coli, in eukaryotic systems, such as yeast, and in in vitro transcription/translation systems, such as the rabbit reticulocyte lysate system.

The disclosure provides a method of generating an ARR/LRR or a portion thereof that binds to a particular target by panning a library of the invention with the target and detecting binders. In other related aspects, the disclosure comprises screening methods that may be used to generate or affinity mature ARRs/LRRs with the desired activity. e.g., capable of binding to target proteins with a certain affinity. Affinity maturation can be accomplished by iterative rounds of mutagenesis and selection using systems, such as phage display or in vitro display. Mutagenesis during this process may be the result of site directed mutagenesis to specific protein residues, random mutagenesis due to error-prone PCR, DNA shuffling, and/or a combination of these techniques.

The disclosure provides an isolated, recombinant and/or synthetic protein scaffold comprising at least one VHH. The disclosure further includes, but is not limited to, methods of making and using such nucleic acids and protein scaffolds, including diagnostic and therapeutic compositions, methods and devices.

The compositions of the disclosure offer advantages over conventional therapeutics, such as ability to administer locally, orally, or cross the blood-brain barrier, ability to express in *E. Coli* allowing for increased expression of protein as a function of resources versus mammalian cell expression ability to be engineered into bispecific or tandem molecules that bind to multiple targets or multiple epitopes of the same target, ability to be conjugated to drugs, polymers, and probes, ability to be formulated to high concentrations, and the ability of such molecules to effectively penetrate diseased tissues and tumors.

Production and Generation of Proteins

Proteins of the disclosure can be optionally produced by a cell line, a mixed cell line, an immortalized cell or clonal population of immortalized cells, as well known in the art See, e.g., Ausubel, et al., ed., Current Protocols in Molecular Biology, John Wiley & Sons, Inc., NY, N.Y. (1987-2001); Sambrook, et al., Molecular Cloning: A Laboratory Manual. 2nd Edition, Cold Spring Harbor, N.Y. (1989); Harlow and Lane, Antibodies, a Laboratory Manual, Cold Spring Harbor, N.Y. (1989); Colligan, et al., eds., Current Protocols in Immunology, John Wiley & Sons, Inc., NY (1994-2001); Colligan et al., Current Protocols in Protein Science, John Wiley & Sons, NY, N.Y., (1997-2001).

Amino acids encoding a protein can be altered, added and/or deleted to reduce immunogenicity or reduce, enhance or modify binding, affinity, on-rate, off-rate, avidity, specificity, half-life, stability, solubility or any other suitable characteristic, as known in the art.

Proteins can be engineered with retention of high affinity for an antigen or a ligand as well as other favorable biological properties. To achieve this goal, the proteins can be optionally prepared by a process of analysis of the parental sequences and various conceptual engineered products using three-dimensional models of the parental and engineered sequences. Three-dimensional models are commonly available and are familiar to those skilled in the art. Computer programs are available which illustrate and display probable three-dimensional conformational structures of selected candidate sequences and can measure possible immunogenicity (e.g., Immunofilter program of Xencor, Inc. of Monrovia, Calif.). Inspection of these displays permits analysis of the likely role of the residues in the functioning of the candidate sequence, i.e., the analysis of residues that influence the ability of the protein to bind its antigen. In this way, residues can be selected and combined from the parent and reference sequences so that the desired characteristic, such as affinity for the target antigen(s)/ligand(s), is achieved. Alternatively, or in addition to, the above procedures, other suitable methods of engineering can be used.

Screening of ARRs/LRRs

Screening protein ARRs/LRRs or any portion thereof for specific binding to similar proteins or fragments can be conveniently achieved using nucleotide (DNA or RNA display) or peptide display libraries, for example, in vitro display. This method involves the screening of large collections of peptides for individual members having the desired function or structure. The displayed nucleotide or peptide sequences can be from 3 to 5000 or more nucleotides or amino acids in length, frequently from 5-100 amino acids long, and often from about 8 to 25 amino acids long. In addition to direct chemical synthetic methods for generating peptide libraries, several recombinant DNA methods have been described. One type involves the display of a peptide sequence on the surface of a bacteriophage or cell. Each bacteriophage or cell contains the nucleotide sequence encoding the particular displayed peptide sequence. Such methods are described in PCT Patent Publication Nos. 91/17271, 91/18980, 91/19818, and 93/08278.

Other systems for generating libraries of peptides have aspects of both in vitro chemical synthesis and recombinant methods. See, PCT Patent Publication Nos. 92/05258, 92/14843, and 96/19256. See also, U.S. Pat. Nos. 5,658,754; and 5,643,768. Peptide display libraries, vector, and screening kits are commercially available from such suppliers as Invitrogen (Carlsbad, Calif.), and Cambridge Antibody Technologies (Cambridgeshire, UK). See, e.g., U.S. Pat. Nos. 4,704,692, 4,939,666, 4,946,778, 5,260,203, 5,455, 030, 5,518,889, 5,534,621, 5,656,730, 5,763,733, 5,767,260, 5,856,456, assigned to Enzon; U.S. Pat. Nos. 5,223,409, 5,403,484, 5,571,698, 5,837,500, assigned to Dyax, U.S. Pat. Nos. 5,427,908, 5,580,717, assigned to Affymax; U.S. Pat. No. 5,885,793, assigned to Cambridge Antibody Technologies; U.S. Pat. No. 5,750,373, assigned to Genentech, U.S. Pat. Nos. 5,618,920, 5,595,898, 5,576,195, 5,698,435, 5,693,493, 5,698,417, assigned to Xoma, Colligan, supra; Ausubel, supra; or Sambrook, supra.

The ARRs/LRRs of the disclosure comprising one or more of a protein scaffold, an antibody, an ScFv, a Centyrin, a single domain antibody, a VHH or a VH of the disclosure can bind human or other mammalian proteins with a wide range of affinities (KD). In a preferred embodiment, at least one ARR/LRR can optionally bind to a target protein with high affinity, for example, with a KD equal to or less than about $10^{-7}$ M, such as but not limited to, 0.1-9.9 (or any range or value therein)$\times 10^{-8}$, $10^{-9}$, $10^{-10}$, $10^{-11}$, $10^{-12}$, $10^{-13}$, $10^{-14}$, $10^{-15}$ or any range or value therein, as determined by surface plasmon resonance or the Kinexa method, as practiced by those of skill in the art. In a preferred embodiment, at least one protein scaffold, antibody, ScFv, Centyrin, single domain antibody, VHH or VH of the disclosure can optionally bind to a target protein with high affinity, for example, with a KD equal to or less than about $10^{-7}$ M, such as but not limited to, 0.1-9.9 (or any range or value therein)$\times 10^{-8}$, $10^{-9}$, $10^{-10}$, $10^{-11}$, $10^{-12}$, $10^{-13}$, $10^{-14}$, $10^{-15}$ or any range or value therein, as determined by surface plasmon resonance or the Kinexa method, as practiced by those of skill in the art.

The affinity or avidity of a protein scaffold, an antibody, an ScFv, a Centyrin, a single domain antibody, a VHH or a VH of the disclosure for an antigen/ligand can be determined experimentally using any suitable method. (See, for example, Berzofsky, et al., "Antibody-Antigen Interactions," In Fundamental Immunology. Paul, W. E., Ed., Raven Press: New York. N.Y. (1984); Kuby, Janis Immunology, W.H. Freeman and Company: New York, N.Y. (1992); and methods described herein). The measured affinity of a particular protein-antigen/ligand interaction can vary if measured under different conditions (e.g., salt concentration. pH). Thus, measurements of affinity and other antigen-binding parameters (e.g., KD, $K_{on}$, $K_{off}$) are preferably made with standardized solutions of protein scaffold (e.g. VHH) and antigen, and a standardized buffer, such as the buffer described herein.

Competitive assays can be performed with the protein scaffold, antibody, ScFv. Centyrin, single domain antibody, VHH or VH of the disclosure in order to determine what proteins, antibodies, and other antagonists compete for binding to a target protein and/or share the epitope region. These assays as readily known to those of ordinary skill in the art evaluate competition between antagonists or ligands for a limited number of binding sites on a protein. The protein and/or antibody is immobilized or insolubilized before or after the competition and the sample bound to the target protein is separated from the unbound sample, for example, by decanting (where the protein/antibody was preinsolubilized) or by centrifuging (where the protein/antibody was precipitated after the competitive reaction). Also, the competitive binding may be determined by whether function is altered by the binding or lack of binding of the protein scaffold, antibody, ScFv, Centyrin, single domain antibody, VHH or VH to the target protein, e.g., whether protein scaffold, antibody, ScFv, Centyrin, single domain antibody, VHH or VH inhibits or potentiates the enzymatic activity of, for example, a label. ELISA and other functional assays may be used, as well known in the art.

Therapeutic Proteins

In certain embodiments of the disclosure. T cells are modified to express therapeutic proteins, including secreted human proteins. These secreted proteins may be used as a monotherapy or in combination with another therapy in the treatment or prevention of any disease or disorder. These secreted proteins may be used as a monotherapy or in combination with another therapy for enzyme replacement and/or administration of biologic therapeutics. A database of human secreted proteins can be found at proteinatlas.org/search/protein_class:Predicted%20secreted%20proteins, the contents of which are incorporated herein by reference. Exemplary human therapeutic proteins can be found, but are not limited to the human proteins in Table 1.

TABLE 1

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| A1BG | Alpha-1-B glycoprotein | SEQ ID NOS: 1-2 |
| A2M | Alpha-2-macroglobulin | SEQ ID NOS: 3-6 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| A2ML1 | Alpha-2-macroglobulin-like 1 | SEQ ID NOS: 7-12 |
| A4GNT | Alpha-1,4-N-acetylglucosaminyltransferase | SEQ ID NO: 13 |
| AADACL2 | Arylacetamide deacetylase-like 2 | SEQ ID NOS: 14-15 |
| AANAT | Aralkylamine N-acetyltransferase | SEQ ID NOS: 16-19 |
| ABCG1 | ATP-binding cassette, sub-family G (WHITE), member 1 | SEQ ID NOS: 20-26 |
| ABHD1 | Abhydrolase domain containing 1 | SEQ ID NOS: 27-31 |
| ABHD10 | Abhydrolase domain containing 10 | SEQ ID NOS: 32-35 |
| ABHD14A | Abhydrolase domain containing 14A | SEQ ID NOS: 36-40 |
| ABHD15 | Abhydrolase domain containing 15 | SEQ ID NO: 41 |
| ABI3BP | ABI family, member 3 (NESH) binding protein | SEQ ID NOS: 42-63 |
| FAM175A | Family with sequence similarity 175, member A | SEQ ID NOS: 64-71 |
| LA16c-380H5.3 | | SEQ ID NO: 72 |
| AC008641.1 | | SEQ ID NO: 73 |
| CTB-60B18.6 | | SEQ ID NOS: 74-75 |
| AC009133.22 | | SEQ ID NO: 76 |
| AC009491.2 | | SEQ ID NO: 77 |
| RP11-977G19.10 | | SEQ ID NOS: 78-80 |
| CTD-2370N5.3 | | SEQ ID NOS: 81-84 |
| RP11-196G11.1 | | SEQ ID NOS: 85-87 |
| AC136352.5 | | SEQ ID NO: 88 |
| RP11-812E19.9 | | SEQ ID NO: 89 |
| AC145212.4 | MaFF-interacting protein | SEQ ID NO: 90 |
| AC233755.1 | | SEQ ID NO: 91 |
| AC011513.3 | | SEQ ID NOS: 92-93 |
| ACACB | Acetyl-CoA carboxylase beta | SEQ ID NOS: 94-100 |
| ACAN | Aggrecan | SEQ ID NOS: 101-108 |
| ACE | Angiotensin I converting enzyme | SEQ ID NOS: 109-121 |
| ACHE | Acetylcholinesterase (Yt blood group) | SEQ ID NOS: 122-134 |
| ACP2 | Acid phosphatase 2, lysosomal | SEQ ID NOS: 135-142 |
| ACP5 | Acid phosphatase 5, tartrate resistant | SEQ ID NOS: 143-151 |
| ACP6 | Acid phosphatase 6, lysophosphatidic | SEQ ID NOS: 152-158 |
| PAPL | Iron/zinc purple acid phosphatase-like protein | SEQ ID NOS: 159-162 |
| ACPP | Acid phosphatase, prostate | SEQ ID NOS: 163-167 |
| ACR | Acrosin | SEQ ID NOS: 168-169 |
| ACRBP | Acrosin binding protein | SEQ ID NOS: 170-174 |
| ACRV1 | Acrosomal vesicle protein 1 | SEQ ID NOS: 175-178 |
| ACSF2 | Acyl-CoA synthetase family member 2 | SEQ ID NOS: 179-187 |
| ACTL10 | Actin-like 10 | SEQ ID NO: 188 |
| ACVR1 | Activin A receptor, type I | SEQ ID NOS: 189-197 |
| ACVR1C | Activin A receptor, type IC | SEQ ID NOS: 198-201 |
| ACVRL1 | Activin A receptor type II-like 1 | SEQ ID NOS: 202-207 |
| ACYP1 | Acylphosphatase 1, erythrocyte (common) type | SEQ ID NOS: 208-213 |
| ACYP2 | Acylphosphatase 2, muscle type | SEQ ID NOS: 214-221 |
| CECR1 | Cat eye syndrome chromosome region, candidate 1 | SEQ ID NOS: 222-229 |
| ADAM10 | ADAM metallopeptidase domain 10 | SEQ ID NOS: 230-237 |
| ADAM12 | ADAM metallopeptidase domain 12 | SEQ ID NOS: 238-240 |
| ADAM15 | ADAM metallopeptidase domain 15 | SEQ ID NOS: 241-252 |
| ADAM17 | ADAM metallopeptidase domain 17 | SEQ ID NOS: 253-255 |
| ADAM18 | ADAM metallopeptidase domain 18 | SEQ ID NOS: 256-260 |
| ADAM22 | ADAM metallopeptidase domain 22 | SEQ ID NOS: 261-269 |
| ADAM28 | ADAM metallopeptidase domain 28 | SEQ ID NOS: 270-275 |
| ADAM29 | ADAM metallopeptidase domain 29 | SEQ ID NOS: 276-284 |
| ADAM32 | ADAM metallopeptidase domain 32 | SEQ ID NOS: 285-291 |
| ADAM33 | ADAM metallopeptidase domain 33 | SEQ ID NOS: 292-296 |
| ADAM7 | ADAM metallopeptidase domain 7 | SEQ ID NOS: 297-300 |
| ADAM8 | ADAM metallopeptidase domain 8 | SEQ ID NOS: 301-305 |
| ADAM9 | ADAM metallopeptidase domain 9 | SEQ ID NOS: 306-311 |
| ADAMDEC1 | ADAM-like, decysin 1 | SEQ ID NOS: 312-314 |
| ADAMTS1 | ADAM metallopeptidase with thrombospondin type 1 motif, 1 | SEQ ID NOS: 315-318 |
| ADAMTS10 | ADAM metallopeptidase with thrombospondin type 1 motif, 10 | SEQ ID NOS: 319-324 |
| ADAMTS12 | ADAM metallopeptidase with thrombospondin type 1 motif, 12 | SEQ ID NOS: 325-327 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| ADAMTS13 | ADAM metallopeptidase with thrombospondin type 1 motif, 13 | SEQ ID NOS: 328-335 |
| ADAMTS14 | ADAM metallopeptidase with thrombospondin type 1 motif, 14 | SEQ ID NOS: 336-337 |
| ADAMTS15 | ADAM metallopeptidase with thrombospondin type 1 motif, 15 | SEQ ID NO: 338 |
| ADAMTS16 | ADAM metallopeptidase with thrombospondin type 1 motif, 16 | SEQ ID NOS: 339-340 |
| ADAMTS17 | ADAM metallopeptidase with thrombospondin type 1 motif, 17 | SEQ ID NOS: 341-344 |
| ADAMTS18 | ADAM metallopeptidase with thrombospondin type 1 motif, 18 | SEQ ID NOS: 345-348 |
| ADAMTS19 | ADAM metallopeptidase with thrombospondin type 1 motif, 19 | SEQ ID NOS: 349-352 |
| ADAMTS2 | ADAM metallopeptidase with thrombospondin type 1 motif, 2 | SEQ ID NOS: 353-355 |
| ADAMTS20 | ADAM metallopeptidase with thrombospondin type 1 motif, 20 | SEQ ID NOS: 356-359 |
| ADAMTS3 | ADAM metallopeptidase with thrombospondin type 1 motif, 3 | SEQ ID NOS: 360-361 |
| ADAMTS5 | ADAM metallopeptidase with thrombospondin type 1 motif, 5 | SEQ ID NO: 362 |
| ADAMTS6 | ADAM metallopeptidase with thrombospondin type 1 motif, 6 | SEQ ID NOS: 363-364 |
| ADAMTS7 | ADAM metallopeptidase with thrombospondin type 1 motif, 7 | SEQ ID NO: 365 |
| ADAMTS8 | ADAM metallopeptidase with thrombospondin type 1 motif, 8 | SEQ ID NO: 366 |
| ADAMTS9 | ADAM metallopeptidase with thrombospondin type 1 motif, 9 | SEQ ID NOS: 367-371 |
| ADAMTSL1 | ADAMTS-like 1 | SEQ ID NOS: 372-382 |
| ADAMTSL2 | ADAMTS-like 2 | SEQ ID NOS: 383-385 |
| ADAMTSL3 | ADAMTS-like 3 | SEQ ID NOS: 386-387 |
| ADAMTSL4 | ADAMTS-like 4 | SEQ ID NOS: 388-391 |
| ADAMTSL5 | ADAMTS-like 5 | SEQ ID NOS: 392-397 |
| ADCK1 | AarF domain containing kinase 1 | SEQ ID NOS: 398-402 |
| ADCYAP1 | Adenylate cyclase activating polypeptide 1 (pituitary) | SEQ ID NOS: 403-404 |
| ADCYAP1R1 | Adenylate cyclase activating polypeptide 1 (pituitary) receptor type I | SEQ ID NOS: 405-411 |
| ADGRA3 | Adhesion G protein-coupled receptor A3 | SEQ ID NOS: 412-416 |
| ADGRB2 | Adhesion G protein-coupled receptor B2 | SEQ ID NOS: 417-425 |
| ADGRD1 | Adhesion G protein-coupled receptor D1 | SEQ ID NOS: 426-431 |
| ADGRE3 | Adhesion G protein-coupled receptor E3 | SEQ ID NOS: 432-436 |
| ADGRE5 | Adhesion G protein-coupled receptor E5 | SEQ ID NOS: 437-442 |
| ADGRF1 | Adhesion G protein-coupled receptor F1 | SEQ ID NOS: 443-447 |
| ADGRG1 | Adhesion G protein-coupled receptor G1 | SEQ ID NOS: 448-512 |
| ADGRG5 | Adhesion G protein-coupled receptor G5 | SEQ ID NOS: 513-515 |
| ADGRG6 | Adhesion G protein-coupled receptor G6 | SEQ ID NOS: 516-523 |
| ADGRV1 | Adhesion G protein-coupled receptor V1 | SEQ ID NOS: 524-540 |
| ADI1 | Acireductone dioxygenase 1 | SEQ ID NOS: 541-543 |
| ADIG | Adipogenin | SEQ ID NOS: 544-547 |
| ADIPOQ | Adiponectin, C1Q and collagen domain containing | SEQ ID NOS: 548-549 |
| ADM | Adrenomedullin | SEQ ID NOS: 550-557 |
| ADM2 | Adrenomedullin 2 | SEQ ID NOS: 558-559 |
| ADM5 | Adrenomedullin 5 (putative) | SEQ ID NO: 560 |
| ADPGK | ADP-dependent glucokinase | SEQ ID NOS: 561-570 |
| ADPRHL2 | ADP-ribosylhydrolase like 2 | SEQ ID NO: 571 |
| AEBP1 | AE binding protein 1 | SEQ ID NOS: 572-579 |
| LACE1 | Lactation elevated 1 | SEQ ID NOS: 580-583 |
| AFM | Afamin | SEQ ID NO: 584 |
| AFP | Alpha-fetoprotein | SEQ ID NOS: 585-586 |
| AGA | Aspartylglucosaminidase | SEQ ID NOS: 587-589 |
| AGER | Advanced glycosylation end product-specific receptor | SEQ ID NOS: 590-600 |
| AGK | Acylglycerol kinase | SEQ ID NOS: 601-606 |
| AGPS | Alkylglycerone phosphate synthase | SEQ ID NOS: 607-610 |
| AGR2 | Anterior gradient 2, protein disulphide isomerase family member | SEQ ID NOS: 611-614 |
| AGR3 | Anterior gradient 3, protein disulphide isomerase family member | SEQ ID NOS: 615-617 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| AGRN | Agrin | SEQ ID NOS: 618-621 |
| AGRP | Agouti related neuropeptide | SEQ ID NO: 622 |
| AGT | Angiotensinogen (serpin peptidase inhibitor, clade A, member 8) | SEQ ID NO: 623 |
| AGTPBP1 | ATP/GTP binding protein 1 | SEQ ID NOS: 624-627 |
| AGTRAP | Angiotensin II receptor-associated protein | SEQ ID NOS: 628-635 |
| AHCYL2 | Adenosylhomocysteinase-like 2 | SEQ ID NOS: 636-642 |
| AHSG | Alpha-2-HS-glycoprotein | SEQ ID NOS: 643-644 |
| AIG1 | Androgen-induced 1 | SEQ ID NOS: 645-653 |
| AK4 | Adenylate kinase 4 | SEQ ID NOS: 654-657 |
| AKAP10 | A kinase (PRKA) anchor protein 10 | SEQ ID NOS: 658-666 |
| AKR1C1 | Aldo-keto reductase family 1, member C1 | SEQ ID NOS: 667-669 |
| RP4-576H24.4 | | SEQ ID NOS: 670-672 |
| SERPINA3 | Serpin peptidase inhibitor, clade A (alpha-1 antiproteinase, antitrypsin), member 3 | SEQ ID NO: 673 |
| RP11-14J7.7 | | SEQ ID NOS: 674-675 |
| RP11-903H12.5 | | SEQ ID NO: 676 |
| AL356289.1 | | SEQ ID NO: 677 |
| AL589743.1 | | SEQ ID NO: 678 |
| XXbac-BPG116M5.17 | | SEQ ID NOS: 679-680 |
| XXbac-BPG181M17.5 | | SEQ ID NO: 681 |
| XXbac-BPG32J3.20 | | SEQ ID NO: 682 |
| RP11-350O14.18 | | SEQ ID NO: 683 |
| ALAS2 | 5'-aminolevulinate synthase 2 | SEQ ID NOS: 684-691 |
| ALB | Albumin | SEQ ID NOS: 692-701 |
| ALDH9A1 | Aldehyde dehydrogenase 9 family, member A1 | SEQ ID NO: 702 |
| ALDOA | Aldolase A, fructose-bisphosphate | SEQ ID NOS: 703-717 |
| ALG1 | ALG1, chitobiosyldiphosphodolichol beta-mannosyltransferase | SEQ ID NOS: 718-723 |
| ALG5 | ALG5, dolichyl-phosphate beta-glucosyltransferase | SEQ ID NOS: 724-725 |
| ALG9 | ALG9, alpha-1,2-mannosyltransferase | SEQ ID NOS: 726-736 |
| FAM150A | Family with sequence similarity 150, member A | SEQ ID NOS: 737-738 |
| FAM150B | Family with sequence similarity 150, member B | SEQ ID NOS: 739-745 |
| ALKBH1 | AlkB homolog 1, histone H2A dioxygenase | SEQ ID NOS: 746-748 |
| ALKBH5 | AlkB homolog 5, RNA demethylase | SEQ ID NOS: 749-750 |
| ALPI | Alkaline phosphatase, intestinal | SEQ ID NOS: 751-752 |
| ALPL | Alkaline phosphatase, liver/bone/kidney | SEQ ID NOS: 753-757 |
| ALPP | Alkaline phosphatase, placental | SEQ ID NO: 758 |
| ALPPL2 | Alkaline phosphatase, placental-like 2 | SEQ ID NO: 759 |
| AMBN | Ameloblastin (enamel matrix protein) | SEQ ID NOS: 760-762 |
| AMBP | Alpha-1-microglobulin/bikunin precursor | SEQ ID NOS: 763-765 |
| AMELX | Amelogenin, X-linked | SEQ ID NOS: 766-768 |
| AMELY | Amelogenin, Y-linked | SEQ ID NOS: 769-770 |
| AMH | Anti-Mullerian hormone | SEQ ID NO: 771 |
| AMPD1 | Adenosine monophosphate deaminase 1 | SEQ ID NOS: 772-774 |
| AMTN | Amelotin | SEQ ID NOS: 775-776 |
| AMY1A | Amylase, alpha 1A (salivary) | SEQ ID NOS: 777-779 |
| AMY1B | Amylase, alpha 1B (salivary) | SEQ ID NOS: 780-783 |
| AMY1C | Amylase, alpha 1C (salivary) | SEQ ID NO: 784 |
| AMY2A | Amylase, alpha 2A (pancreatic) | SEQ ID NOS: 785-787 |
| AMY2B | Amylase, alpha 2B (pancreatic) | SEQ ID NOS: 788-792 |
| ANG | Angiogenin, ribonuclease, RNase A family, 5 | SEQ ID NOS: 793-794 |
| ANGEL1 | Angel homolog 1 (*Drosophila*) | SEQ ID NOS: 795-798 |
| ANGPT1 | Angiopoietin 1 | SEQ ID NOS: 799-803 |
| ANGPT2 | Angiopoietin 2 | SEQ ID NOS: 804-807 |
| ANGPT4 | Angiopoietin 4 | SEQ ID NO: 808 |
| ANGPTL1 | Angiopoietin-like 1 | SEQ ID NOS: 809-811 |
| ANGPTL2 | Angiopoietin-like 2 | SEQ ID NOS: 812-813 |
| ANGPTL3 | Angiopoietin-like 3 | SEQ ID NO: 814 |
| ANGPTL4 | Angiopoietin-like 4 | SEQ ID NOS: 815-822 |
| ANGPTL5 | Angiopoietin-like 5 | SEQ ID NOS: 823-824 |
| ANGPTL6 | Angiopoietin-like 6 | SEQ ID NOS: 825-827 |
| ANGPTL7 | Angiopoietin-like 7 | SEQ ID NO: 828 |
| C19orf80 | Chromosome 19 open reading frame 80 | SEQ ID NOS: 829-832 |
| ANK1 | Ankyrin 1, erythrocytic | SEQ ID NOS: 833-843 |
| ANKDD1A | Ankyrin repeat and death domain containing 1A | SEQ ID NOS: 844-850 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| ANKRD54 | Ankyrin repeat domain 54 | SEQ ID NOS: 851-859 |
| ANKRD60 | Ankyrin repeat domain 60 | SEQ ID NO: 860 |
| ANO7 | Anoctamin 7 | SEQ ID NOS: 861-864 |
| ANOS1 | Anosmin 1 | SEQ ID NO: 865 |
| ANTXR1 | Anthrax toxin receptor 1 | SEQ ID NOS: 866-869 |
| AOAH | Acyloxyacyl hydrolase (neutrophil) | SEQ ID NOS: 870-874 |
| AOC1 | Amine oxidase, copper containing 1 | SEQ ID NOS: 875-880 |
| AOC2 | Amine oxidase, copper containing 2 (retina-specific) | SEQ ID NOS: 881-882 |
| AOC3 | Amine oxidase, copper containing 3 | SEQ ID NOS: 883-889 |
| AP000721.4 | | SEQ ID NO: 890 |
| APBB1 | Amyloid beta (A4) precursor protein-binding, family B, member I (Fe65) | SEQ ID NOS: 891-907 |
| APCDD1 | Adenomatosis polyposis coli down-regulated 1 | SEQ ID NOS: 908-913 |
| APCS | Amyloid P component, serum | SEQ ID NO: 914 |
| APELA | Apelin receptor early endogenous ligand | SEQ ID NOS: 915-917 |
| APLN | Apelin | SEQ ID NO: 918 |
| APLP2 | Amyloid beta (A4) precursor-like protein 2 | SEQ ID NOS: 919-928 |
| APOA1 | Apolipoprotein A-I | SEQ ID NOS: 929-933 |
| APOA2 | Apolipoprotein A-II | SEQ ID NOS: 934-942 |
| APOA4 | Apolipoprotein A-IV | SEQ ID NO: 943 |
| APOA5 | Apolipoprotein A-V | SEQ ID NOS: 944-946 |
| APOB | Apolipoprotein B | SEQ ID NOS: 947-948 |
| APOC1 | Apolipoprotein C-I | SEQ ID NOS: 949-957 |
| APOC2 | Apolipoprotein C-II | SEQ ID NOS: 958-962 |
| APOC3 | Apolipoprotein C-III | SEQ ID NOS: 963-966 |
| APOC4 | Apolipoprotein C-IV | SEQ ID NOS: 967-968 |
| APOC4-APOC2 | APOC4-APOC2 readthrough (NMD candidate) | SEQ ID NOS: 969-970 |
| APOD | Apolipoprotein D | SEQ ID NOS: 971-974 |
| APOE | Apolipoprotein E | SEQ ID NOS: 975-978 |
| APOF | Apolipoprotein F | SEQ ID NO: 979 |
| APOH | Apolipoprotein H (beta-2-glycoprotein I) | SEQ ID NOS: 980-983 |
| APOL1 | Apolipoprotein L, 1 | SEQ ID NOS: 984-994 |
| APOL3 | Apolipoprotein L, 3 | SEQ ID NOS: 995-1009 |
| APOM | Apolipoprotein M | SEQ ID NOS: 1010-1012 |
| APOOL | Apolipoprotein O-like | SEQ ID NOS: 1013-1015 |
| ARCN1 | Archain 1 | SEQ ID NOS: 1016-1020 |
| ARFIP2 | ADP-ribosylation factor interacting protein 2 | SEQ ID NOS: 1021-1027 |
| ARHGAP36 | Rho GTPase activating protein 36 | SEQ ID NOS: 1028-1033 |
| HMHA1 | Histocompatibility (minor) HA-1 | SEQ ID NOS: 1034-1042 |
| ARHGAP6 | Rho GTPase activating protein 6 | SEQ ID NOS: 1043-1048 |
| ARIIGEF4 | Rho guanine nucleotide exchange factor (GEF) 4 | SEQ ID NOS: 1049-1059 |
| ARL16 | ADP-ribosylation factor-like 16 | SEQ ID NOS: 1060-1068 |
| ARMC5 | Armadillo repeat containing 5 | SEQ ID NOS: 1069-1075 |
| ARNTL | Aryl hydrocarbon receptor nuclear translocator-like | SEQ ID NOS: 1076-1090 |
| ARSA | Arylsulfatase A | SEQ ID NOS: 1091-1096 |
| ARSB | Arylsulfatase B | SEQ ID NOS: 1097-1100 |
| ARSE | Arylsulfatase E (chondrodysplasia punctata 1) | SEQ ID NOS: 1101-1104 |
| ARSG | Arylsulfatase G | SEQ ID NOS: 1105-1108 |
| ARSI | Arylsulfatase family, member I | SEQ ID NOS: 1109-1111 |
| ARSK | Arylsulfatase family, member K | SEQ ID NOS: 1112-1116 |
| ARTS | ADP-ribosyltransferase 3 | SEQ ID NOS: 1117-1124 |
| ART4 | ADP-ribosyltransferase 4 (Dombrock blood group) | SEQ ID NOS: 1125-1128 |
| ART5 | ADP-ribosyltransferase 5 | SEQ ID NOS: 1129-1133 |
| ARTN | Artemin | SEQ ID NOS: 1134-1144 |
| ASAH1 | N-acylsphingosine amidohydrolase (acid ceramidase) 1 | SEQ ID NOS: 1145-1195 |
| ASAH2 | N-acylsphingosine amidohydrolase (non-lysosomal ceramidase) 2 | SEQ ID NOS: 1196-1201 |
| ASCL1 | Achaete-scute family bHLH transcription factor 1 | SEQ ID NO: 1202 |
| ASIP | Agouti signaling protein | SEQ ID NOS: 1203-1204 |
| ASPN | Asporin | SEQ ID NOS: 1205-1206 |
| ASTL | Astacin-like metallo-endopeptidase (M12 family) | SEQ ID NO: 1207 |
| ATAD5 | ATPase family, AAA domain containing 5 | SEQ ID NOS: 1208-1209 |
| ATAT1 | Alpha tubulin acetyltransferase 1 | SEQ ID NOS: 1210-1215 |
| ATG2A | Autophagy related 2A | SEQ ID NOS: 1216-1218 |
| ATG5 | Autophagy related 5 | SEQ ID NOS: 1219-1227 |
| ATMIN | ATM interactor | SEQ ID NOS: 1228-1231 |
| ATP13A1 | ATPase type 13A1 | SEQ ID NOS: 1232-1234 |
| ATP5F1 | ATP synthase, H+ transporting, mitochondrial Fo complex, subunit B1 | SEQ ID NOS: 1235-1236 |
| ATP6AP1 | ATPase, H+ transporting, lysosomal accessory protein 1 | SEQ ID NOS: 1237-1244 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| ATP6AP2 | ATPase, H+ transporting, lysosomal accessory protein 2 | SEQ ID NOS: 1245-1267 |
| ATPAF1 | ATP synthase mitochondrial F1 complex assembly factor 1 | SEQ ID NOS: 1268-1278 |
| AUH | AU RNA binding protein/enoyl-CoA hydratase | SEQ ID NOS: 1279-1280 |
| AVP | Arginine vasopressin | SEQ ID NO: 1281 |
| AXIN2 | Axin 2 | SEQ ID NOS: 1282-1289 |
| AZGP1 | Alpha-2-glycoprotein 1, zinc-binding | SEQ ID NOS: 1290-1292 |
| AZU1 | Azurocidin 1 | SEQ ID NOS: 1293-1294 |
| B2M | Beta-2-microglobulin | SEQ ID NOS: 1295-1301 |
| B3GALNT1 | Beta-1,3-N-acetylgalactosaminyltransferase 1 (globoside blood group) | SEQ ID NOS: 1302-1314 |
| B3GALNT2 | Beta-1,3-N-acetylgalactosaminyltransferase 2 | SEQ ID NOS: 1315-1317 |
| B3GALT1 | UDP-Gal:betaGlcNAc beta 1,3-galactosyltransferase, polypeptide 1 | SEQ ID NO: 1318 |
| B3GALT4 | UDP-Gal:betaGlcNAc beta 1,3-galactosyltransferase, polypeptide 4 | SEQ ID NO: 1319 |
| B3GALT5 | UDP-Gal:betaGlcNAc beta 1,3-galactosyltransferase, polypeptide 5 | SEQ ID NOS: 1320-1324 |
| B3GALT6 | UDP-Gal:betaGal beta 1,3-galactosyltransferase polypeptide 6 | SEQ ID NO: 1325 |
| B3GAT3 | Beta-1,3-glucuronyltransferase 3 | SEQ ID NOS: 1326-1330 |
| B3GLCT | Beta 3-glucosyltransferase | SEQ ID NO: 1331 |
| B3GNT3 | UDP-GlcNAc:betaGal beta-1,3-N-acetylglucosaminyltransferase 3 | SEQ ID NOS: 1332-1335 |
| B3GNT4 | UDP-GlcNAc:betaGal beta-1,3-N-acetylglucosaminyltransferase 4 | SEQ ID NOS: 1336-1339 |
| B3GNT6 | UDP-GlcNAc:betaGal beta-1,3-N-acetylglucosaminyltransferase 6 | SEQ ID NOS: 1340-1341 |
| B3GNT7 | UDP-GlcNAc:betaGal beta-1,3-N-acetylglucosaminyltransferase 7 | SEQ ID NO: 1342 |
| B3GNT8 | UDP-GlcNAc:betaGal beta-1,3-N-acetylglucosaminyltransferase 8 | SEQ ID NO: 1343 |
| B3GNT9 | UDP-GlcNAc:betaGal beta-1,3-N-acetylglucosaminyltransferase 9 | SEQ ID NO: 1344 |
| B4GALNT1 | Beta-1,4-N-acetyl-galactosaminyl transferase 1 | SEQ ID NOS: 1345-1356 |
| B4GALNT3 | Beta-1,4-N-acetyl-galactosaminyl transferase 3 | SEQ ID NOS: 1357-1358 |
| B4GALNT4 | Beta-1,4-N-acetyl-galactosaminyl transferase 4 | SEQ ID NOS: 1359-1361 |
| B4GALT4 | UDP-Gal:betaGlcNAc beta 1,4-galactosyltransferase, polypeptide 4 | SEQ ID NOS: 1362-1375 |
| B4GALT5 | UDP-Gal:betaGlcNAc beta 1,4-galactosyltransferase, polypeptide 5 | SEQ ID NO: 1376 |
| B4GALT6 | UDP-Gal:betaGlcNAc beta 1,4-galactosyltransferase, polypeptide 6 | SEQ ID NOS: 1377-1380 |
| B4GAT1 | Beta-1,4-glucuronyltransferase 1 | SEQ ID NO: 1381 |
| B9D1 | B9 protein domain 1 | SEQ ID NOS: 1382-1398 |
| BACE2 | Beta-site APP-cleaving enzyme 2 | SEQ ID NOS: 1399-1401 |
| BAGE5 | B melanoma antigen family, member 5 | SEQ ID NO: 1402 |
| BCAM | Basal cell adhesion molecule (Lutheran blood group) | SEQ ID NOS: 1403-1406 |
| BCAN | Brevican | SEQ ID NOS: 1407-1413 |
| BCAP29 | B-cell receptor-associated protein 29 | SEQ ID NOS: 1414-1426 |
| BCAR1 | Breast cancer anti-estrogen resistance 1 | SEQ ID NOS: 1427-1444 |
| BCHE | Butyrylcholinesterase | SEQ ID NOS: 1445-1449 |
| BCKDHB | Branched chain keto acid dehydrogenase E1, beta polypeptide | SEQ ID NOS: 1450-1452 |
| BDNF | Brain-derived neurotrophic factor | SEQ ID NOS: 1453-1470 |
| BGLAP | Bone gamma-carboxyglutamate (gla) protein | SEQ ID NO: 1471 |
| BGN | Biglycan | SEQ ID NOS: 1472-1473 |
| BLVRB | Biliverdin reductase B | SEQ ID NOS: 1474-1478 |
| BMP1 | Bone morphogenetic protein 1 | SEQ ID NOS: 1479-1490 |
| BMP10 | Bone morphogenetic protein 10 | SEQ ID NO: 1491 |
| BMP15 | Bone morphogenetic protein 15 | SEQ ID NO: 1492 |
| BMP2 | Bone morphogenetic protein 2 | SEQ ID NO: 1493 |
| BMP3 | Bone morphogenetic protein 3 | SEQ ID NO: 1494 |
| BMP4 | Bone morphogenetic protein 4 | SEQ ID NOS: 1495-1502 |
| BMP6 | Bone morphogenetic protein 6 | SEQ ID NO: 1503 |
| BMP7 | Bone morphogenetic protein 7 | SEQ ID NOS: 1504-1507 |
| BMP8A | Bone morphogenetic protein 8a | SEQ ID NO: 1508 |
| BMP8B | Bone morphogenetic protein 8b | SEQ ID NO: 1509 |
| BMPER | BMP binding endothelial regulator | SEQ ID NOS: 1510-1513 |
| BNC1 | Basonuclin 1 | SEQ ID NOS: 1514-1515 |
| BOC | BOC cell adhesion associated, oncogene regulated | SEQ ID NOS: 1516-1526 |
| BOD1 | Biorientation of chromosomes in cell division 1 | SEQ ID NOS: 1527-1531 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| BOLA1 | BolA family member 1 | SEQ ID NOS: 1532-1534 |
| BPI | Bactericidal/permeability-increasing protein | SEQ ID NOS: 1535-1538 |
| BPIFA1 | BPI fold containing family A, member 1 | SEQ ID NOS: 1539-1542 |
| BPIFA2 | BPI fold containing family A, member 2 | SEQ ID NOS: 1543-1544 |
| BPIFA3 | BPI fold containing family A. member 3 | SEQ ID NOS: 1545-1546 |
| BPIFB1 | BPI fold containing family B, member 1 | SEQ ID NOS: 1547-1548 |
| BPIFB2 | BPI fold containing family B, member 2 | SEQ ID NO: 1549 |
| BPIFB3 | BPI fold containing family B, member 3 | SEQ ID NO: 1550 |
| BPIFB4 | BPI fold containing family B, member 4 | SEQ ID NOS: 1551-1552 |
| BPIFB6 | BPI fold containing family B, member 6 | SEQ ID NOS: 1553-1554 |
| BPIFC | BPI fold containing family C | SEQ ID NOS: 1555-1558 |
| BRF1 | BRF1, RNA polymerase III transcription initiation factor 90 kDa subunit | SEQ ID NOS: 1559-1574 |
| BRINP1 | Bone morphogenetic protein/retinoic acid inducible neural-specific 1 | SEQ ID NOS: 1575-1576 |
| BRINP2 | Bone morphogenetic protein/retinoic acid inducible neural-specific 2 | SEQ ID NO: 1577 |
| BRINP3 | Bone morphogenetic protein/retinoic acid inducible neural-specific 3 | SEQ ID NOS: 1578-1580 |
| BSG | Basigin (Ok blood group) | SEQ ID NOS: 1581-1591 |
| BSPH1 | Binder of sperm protein homolog 1 | SEQ ID NO: 1592 |
| BST1 | Bone marrow stromal cell antigen 1 | SEQ ID NOS: 1593-1597 |
| BTBD17 | BTB (POZ) domain containing 17 | SEQ ID NO: 1598 |
| BTD | Biotinidase | SEQ ID NOS: 1599-1608 |
| BTN2A2 | Butyrophilin, subfamily 2, member A2 | SEQ ID NOS: 1609-1622 |
| BTN3A1 | Butyrophilin, subfamily 3, member A1 | SEQ ID NOS: 1623-1629 |
| BTN3A2 | Butyrophilin, subfamily 3, member A2 | SEQ ID NOS: 1630-1640 |
| BTN3A3 | Butyrophilin, subfamily 3, member A3 | SEQ ID NOS: 1641-1649 |
| RP4-608O15.3 | Complement factor H-related protein 2 | SEQ ID NO: 1650 |
| C10orf99 | Chromosome 10 open reading frame 99 | SEQ ID NO: 1651 |
| C11orf1 | Chromosome 11 open reading frame 1 | SEQ ID NOS: 1652-1656 |
| C11orf24 | Chromosome 11 open reading frame 24 | SEQ ID NOS: 1657-1659 |
| C11orf45 | Chromosome 11 open reading frame 45 | SEQ ID NOS: 1660-1661 |
| C11orf94 | Chromosome 11 open reading frame 94 | SEQ ID NO: 1662 |
| C12orf10 | Chromosome 12 open reading frame 10 | SEQ ID NOS: 1663-1666 |
| C12orf49 | Chromosome 12 open reading frame 49 | SEQ ID NOS: 1667-1670 |
| C12orf73 | Chromosome 12 open reading frame 73 | SEQ ID NOS: 1671-1680 |
| C12orf76 | Chromosome 12 open reading frame 76 | SEQ ID NOS: 1681-1688 |
| C14orf93 | Chromosome 14 open reading frame 93 | SEQ ID NOS: 1689-1704 |
| C16orf89 | Chromosome 16 open reading frame 89 | SEQ ID NOS: 1705-1707 |
| C16orf90 | Chromosome 16 open reading frame 90 | SEQ ID NOS: 1708-1709 |
| C17orf67 | Chromosome 17 open reading frame 67 | SEQ ID NO: 1710 |
| C17orf75 | Chromosome 17 open reading frame 75 | SEQ ID NOS: 1711-1719 |
| C17orf99 | Chromosome 17 open reading frame 99 | SEQ ID NOS: 1720-1722 |
| C18orf54 | Chromosome 18 open reading frame 54 | SEQ ID NOS: 1723-1727 |
| C19orf47 | Chromosome 19 open reading frame 47 | SEQ ID NOS: 1728-1735 |
| C19orf70 | Chromosome 19 open reading frame 70 | SEQ ID NOS: 1736-1739 |
| C1GALT1 | Core 1 synthase, glycoprotein-N-acetylgalactosamine 3-beta-galactosyltransferase 1 | SEQ ID NOS: 1740-1744 |
| C1orf127 | Chromosome 1 open reading frame 127 | SEQ ID NOS: 1745-1748 |
| C1orf159 | Chromosome 1 open reading frame 159 | SEQ ID NOS: 1749-1761 |
| C1orf198 | Chromosome 1 open reading frame 198 | SEQ ID NOS: 1762-1766 |
| C1orf54 | Chromosome 1 open reading frame 54 | SEQ ID NOS: 1767-1769 |
| C1orf56 | Chromosome 1 open reading frame 56 | SEQ ID NO: 1770 |
| C1QA | Complement component 1, q subcomponent, A chain | SEQ ID NOS: 1771-1773 |
| C1QB | Complement component 1, q subcomponent, B chain | SEQ ID NOS: 1774-1777 |
| C1QC | Complement component 1, q subcomponent, C chain | SEQ ID NOS: 1778-1780 |
| C1QL1 | Complement component 1, q subcomponent-like 1 | SEQ ID NO: 1781 |
| C1QL2 | Complement component 1, q subcomponent-like 2 | SEQ ID NO: 1782 |
| C1QL3 | Complement component 1, q subcomponent-like 3 | SEQ ID NOS: 1783-1784 |
| C1QL4 | Complement component 1, q subcomponent-like 4 | SEQ ID NO: 1785 |
| C1QTNF1 | C1q and tumor necrosis factor related protein 1 | SEQ ID NOS: 1786-1795 |
| FAM132A | Family with sequence similarity 132, member A | SEQ ID NO: 1796 |
| C1QTNF2 | C1q and tumor necrosis factor related protein 2 | SEQ ID NO: 1797 |
| C1QTNF3 | C1q and tumor necrosis factor related protein 3 | SEQ ID NOS: 1798-1799 |
| C1QTNF4 | C1q and tumor necrosis factor related protein 4 | SEQ ID NOS: 1800-1801 |
| C1QTNF5 | C1q and tumor necrosis factor related protein 5 | SEQ ID NOS: 1802-1804 |
| C1QTNF7 | C1q and tumor necrosis factor related protein 7 | SEQ ID NOS: 1805-1809 |
| C1QTNF8 | C1q and tumor necrosis factor related protein 8 | SEQ ID NOS: 1810-1811 |
| C1QTNF9 | C1q and tumor necrosis factor related protein 9 | SEQ ID NOS: 1812-1813 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| C1QTNF9B | C1q and tumor necrosis factor related protein 9B | SEQ ID NOS: 1814-1816 |
| C1R | Complement component 1, r subcomponent | SEQ ID NOS: 1817-1825 |
| C1RL | Complement component 1, r subcomponent-like | SEQ ID NOS: 1826-1834 |
| C1S | Complement component 1, s subcomponent | SEQ ID NOS: 1835-1844 |
| C2 | Complement component 2 | SEQ ID NOS: 1845-1859 |
| C21orf33 | Chromosome 21 open reading frame 33 | SEQ ID NOS: 1860-1868 |
| C21orf62 | Chromosome 21 open reading frame 62 | SEQ ID NOS: 1869-1872 |
| C22orf15 | Chromosome 22 open reading frame 15 | SEQ ID NOS: 1873-1875 |
| C22orf46 | Chromosome 22 open reading frame 46 | SEQ ID NO: 1876 |
| C2CD2 | C2 calcium-dependent domain containing 2 | SEQ ID NOS: 1877-1879 |
| C2orf40 | Chromosome 2 open reading frame 40 | SEQ ID NOS: 1880-1882 |
| C2orf66 | Chromosome 2 open reading frame 66 | SEQ ID NO: 1883 |
| C2orf69 | Chromosome 2 open reading frame 69 | SEQ ID NO: 1884 |
| C2orf78 | Chromosome 2 open reading frame 78 | SEQ ID NO: 1885 |
| C3 | Complement component 3 | SEQ ID NOS: 1886-1890 |
| C3orf33 | Chromosome 3 open reading frame 33 | SEQ ID NOS: 1891-1895 |
| C3orf58 | Chromosome 3 open reading frame 58 | SEQ ID NOS: 1896-1899 |
| C4A | Complement component 4A (Rodgers blood group) | SEQ ID NOS: 1900-1901 |
| C4B | Complement component 4B (Chido blood group) | SEQ ID NOS: 1902-1903 |
| C4BPA | Complement component 4 binding protein, alpha | SEQ ID NOS: 1904-1906 |
| C4BPB | Complement component 4 binding protein, beta | SEQ ID NOS: 1907-1911 |
| C4orf48 | Chromosome 4 open reading frame 48 | SEQ ID NOS: 1912-1913 |
| C5 | Complement component 5 | SEQ ID NO: 1914 |
| C5orf46 | Chromosome 5 open reading frame 46 | SEQ ID NOS: 1915-1916 |
| C6 | Complement component 6 | SEQ ID NOS: 1917-1920 |
| C6orf120 | Chromosome 6 open reading frame 120 | SEQ ID NO: 1921 |
| C6orf15 | Chromosome 6 open reading frame 15 | SEQ ID NO: 1922 |
| C6orf58 | Chromosome 6 open reading frame 58 | SEQ ID NO: 1923 |
| C7 | Complement component 7 | SEQ ID NO: 1924 |
| C7orf57 | Chromosome 7 open reading frame 57 | SEQ ID NOS: 1925-1929 |
| C8A | Complement component 8, alpha polypeptide | SEQ ID NO: 1930 |
| C8B | Complement component 8, beta polypeptide | SEQ ID NOS: 1931-1933 |
| C8G | Complement component 8, gamma polypeptide | SEQ ID NOS: 1934-1935 |
| C9 | Complement component 9 | SEQ ID NO: 1936 |
| C9orf47 | Chromosome 9 open reading frame 47 | SEQ ID NOS: 1937-1939 |
| CA10 | Carbonic anhydrase X | SEQ ID NOS: 1940-1946 |
| CA11 | Carbonic anhydrase XI | SEQ ID NOS: 1947-1948 |
| CA6 | Carbonic anhydrase VI | SEQ ID NOS: 1949-1953 |
| CA9 | Carbonic anhydrase IX | SEQ ID NOS: 1954-1955 |
| CABLES1 | Cdk5 and Abl enzyme substrate 1 | SEQ ID NOS: 1956-1961 |
| CABP1 | Calcium binding protein 1 | SEQ ID NOS: 1962-1965 |
| CACNA2D1 | Calcium channel, voltage-dependent, alpha 2/delta subunit 1 | SEQ ID NOS: 1966-1969 |
| CACNA2D4 | Calcium channel, voltage-dependent, alpha 2/delta subunit 4 | SEQ ID NOS: 1970-1983 |
| CADM3 | Cell adhesion molecule 3 | SEQ ID NOS: 1984-1986 |
| CALCA | Calcitonin-related polypeptide alpha | SEQ ID NOS: 1987-1991 |
| CALCB | Calcitonin-related polypeptide beta | SEQ ID NOS: 1992-1994 |
| CALCR | Calcitonin receptor | SEQ ID NOS: 1995-2001 |
| CALCRL | Calcitonin receptor-like | SEQ ID NOS: 2002-2006 |
| FAM26D | Family with sequence similarity 26, member D | SEQ ID NOS: 2007-2011 |
| CALR | Calreticulin | SEQ ID NOS: 2012-2015 |
| CALR3 | Calreticulin 3 | SEQ ID NOS: 2016-2017 |
| CALU | Calumenin | SEQ ID NOS: 2018-2023 |
| CAMK2D | Calcium/calmodulin-dependent protein kinase II delta | SEQ ID NOS: 2024-2035 |
| CAMP | Cathelicidin antimicrobial peptide | SEQ ID NO: 2036 |
| CANX | Calnexin | SEQ ID NOS: 2037-2051 |
| CARM1 | Coactivator-associated arginine methyltransferase 1 | SEQ ID NOS: 2052-2059 |
| CARNS1 | Carnosine synthase 1 | SEQ ID NOS: 2060-2062 |
| CARTPT | CART prepropeptide | SEQ ID NO: 2063 |
| CASQ1 | Calsequestrin 1 (fast-twitch, skeletal muscle) | SEQ ID NOS: 2064-2065 |
| CASQ2 | Calsequestrin 2 (cardiac muscle) | SEQ ID NO: 2066 |
| CATSPERG | Catsper channel auxiliary subunit gamma | SEQ ID NOS: 2067-2074 |
| CBLN1 | Cerebellin 1 precursor | SEQ ID NOS: 2075-2077 |
| CBLN2 | Cerebellin 2 precursor | SEQ ID NOS: 2078-2081 |
| CBLN3 | Cerebellin 3 precursor | SEQ ID NOS: 2082-2083 |
| CBLN4 | Cerebellin 4 precursor | SEQ ID NO: 2084 |
| CCBE1 | Collagen and calcium binding EGF domains 1 | SEQ ID NOS: 2085-2087 |
| CCDC112 | Coiled-coil domain containing 112 | SEQ ID NOS: 2088-2091 |
| CCDC129 | Coiled-coil domain containing 129 | SEQ ID NOS: 2092-2099 |
| CCDC134 | Coiled-coil domain containing 134 | SEQ ID NOS: 2100-2101 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| CCDC149 | Coiled-coil domain containing 149 | SEQ ID NOS: 2102-2105 |
| CCDC3 | Coiled-coil domain containing 3 | SEQ ID NOS: 2106-2107 |
| CCDC80 | Coiled-coil domain containing 80 | SEQ ID NOS: 2108-2111 |
| CCDC85A | Coiled-coil domain containing 85A | SEQ ID NO: 2112 |
| CCDC88B | Coiled-coil domain containing 88B | SEQ ID NOS: 2113-2115 |
| CCER2 | Coiled-coil glutamate-rich protein 2 | SEQ ID NOS: 2116-2117 |
| CCK | Cholecystokinin | SEQ ID NOS: 2118-2120 |
| CCL1 | Chemokine (C-C motif) ligand 1 | SEQ ID NO: 2121 |
| CCL11 | Chemokine (C-C motif) ligand 11 | SEQ ID NO: 2122 |
| CCL13 | Chemokine (C-C motif) ligand 13 | SEQ ID NOS: 2123-2124 |
| CCL14 | Chemokine (C-C motif) ligand 14 | SEQ ID NOS: 2125-2128 |
| CCL15 | Chemokine (C-C motif) ligand 15 | SEQ ID NOS: 2129-2130 |
| CCL16 | Chemokine (C-C motif) ligand 16 | SEQ ID NOS: 2131-2133 |
| CCL17 | Chemokine (C-C motif) ligand 17 | SEQ ID NOS: 2134-2135 |
| CCL18 | Chemokine (C-C motif) ligand 18 (pulmonary and activation-regulated) | SEQ ID NO: 2136 |
| CCL19 | Chemokine (C-C motif) ligand 19 | SEQ ID NOS: 2137-2138 |
| CCL2 | Chemokine (C-C motif) ligand 2 | SEQ ID NOS: 2139-2140 |
| CCL20 | Chemokine (C-C motif) ligand 20 | SEQ ID NOS: 2141-2143 |
| CCL21 | Chemokine (C-C motif) ligand 21 | SEQ ID NOS: 2144-2145 |
| CCL22 | Chemokine (C-C motif) ligand 22 | SEQ ID NO: 2146 |
| CCL23 | Chemokine (C-C motif) ligand 23 | SEQ ID NOS: 2147-2149 |
| CCL24 | Chemokine (C-C motif) ligand 24 | SEQ ID NOS: 2150-2151 |
| CCL25 | Chemokine (C-C motif) ligand 25 | SEQ ID NOS: 2152-2155 |
| CCL26 | Chemokine (C-C motif) ligand 26 | SEQ ID NOS: 2156-2157 |
| CCL27 | Chemokine (C-C motif) ligand 27 | SEQ ID NO: 2158 |
| CCL28 | Chemokine (C-C motif) ligand 28 | SEQ ID NOS: 2159-2161 |
| CCL3 | Chemokine (C-C motif) ligand 3 | SEQ ID NO: 2162 |
| CCL3L3 | Chemokine (C-C motif) ligand 3-like 3 | SEQ ID NO: 2163 |
| CCL4 | Chemokine (C-C motif) ligand 4 | SEQ ID NOS: 2164-2165 |
| CCL4L2 | Chemokine (C-C motif) ligand 4-like 2 | SEQ ID NOS: 2166-2175 |
| CCL5 | Chemokine (C-C motif) ligand 5 | SEQ ID NOS: 2176-2178 |
| CCL7 | Chemokine (C-C motif) ligand 7 | SEQ ID NOS: 2179-2181 |
| CCL8 | Chemokine (C-C motif) ligand 8 | SEQ ID NO: 2182 |
| CCNB1IP1 | Cyclin B1 interacting protein 1, E3 ubiquitin protein ligase | SEQ ID NOS: 2183-2194 |
| CCNL1 | Cyclin L1 | SEQ ID NOS: 2195-2203 |
| CCNL2 | Cyclin L2 | SEQ ID NOS: 2204-2211 |
| CD14 | CD14 molecule | SEQ ID NOS: 2212-2216 |
| CD160 | CD160 molecule | SEQ ID NOS: 2217-2221 |
| CD164 | CD164 molecule, sialomucin | SEQ ID NOS: 2222-2227 |
| CD177 | CD177 molecule | SEQ ID NOS: 2228-2230 |
| CD1E | CD1e molecule | SEQ ID NOS: 2231-2244 |
| CD2 | CD2 molecule | SEQ ID NOS: 2245-2246 |
| CD200 | CD200 molecule | SEQ ID NOS: 2247-2253 |
| CD200R1 | CD200 receptor 1 | SEQ ID NOS: 2254-2258 |
| CD22 | CD22 molecule | SEQ ID NOS: 2259-2276 |
| CD226 | CD226 molecule | SEQ ID NOS: 2277-2284 |
| CD24 | CD24 molecule | SEQ ID NOS: 2285-2291 |
| CD276 | CD276 molecule | SEQ ID NOS: 2292-2307 |
| CD300A | CD300a molecule | SEQ ID NOS: 2308-2312 |
| CD300LB | CD300 molecule-like family member b | SEQ ID NOS: 2313-2314 |
| CD300LF | CD300 molecule-like family member f | SEQ ID NOS: 2315-2323 |
| CD300LG | CD300 molecule-like family member g | SEQ ID NOS: 2324-2329 |
| CD3D | CD3d molecule, delta (CD3-TCR complex) | SEQ ID NOS: 2330-2333 |
| CD4 | CD4 molecule | SEQ ID NOS: 2334-2336 |
| CD40 | CD40 molecule, TNF receptor superfamily member 5 | SEQ ID NOS: 2337-2340 |
| CD44 | CD44 molecule (Indian blood group) | SEQ ID NOS: 2341-2367 |
| CD48 | CD48 molecule | SEQ ID NOS: 2368-2370 |
| CD5 | CD5 molecule | SEQ ID NOS: 2371-2372 |
| CD55 | CD55 molecule, decay accelerating factor for complement (Cromer blood group) | SEQ ID NOS: 2373-2383 |
| CD59 | CD59 molecule, complement regulatory protein | SEQ ID NOS: 2384-2394 |
| CD5L | CD5 molecule-like | SEQ ID NO: 2395 |
| CD6 | CD6 molecule | SEQ ID NOS: 2396-2403 |
| CD68 | CD68 molecule | SEQ ID NOS: 2404-2407 |
| CD7 | CD7 molecule | SEQ ID NOS: 2408-2413 |
| CD79A | CD79a molecule, immunoglobulin-associated alpha | SEQ ID NOS: 2414-2416 |
| CD80 | CD80 molecule | SEQ ID NOS: 2417-2419 |
| CD86 | CD86 molecule | SEQ ID NOS: 2420-2426 |
| CD8A | CD8a molecule | SEQ ID NOS: 2427-2430 |
| CD8B | CD8b molecule | SEQ ID NOS: 2431-2436 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| CD99 | CD99 molecule | SEQ ID NOS: 2437-2445 |
| CDC23 | Cell division cycle 23 | SEQ ID NOS: 2446-2450 |
| CDC40 | Cell division cycle 40 | SEQ ID NOS: 2451-2453 |
| CDC45 | Cell division cycle 45 | SEQ ID NOS: 2454-2460 |
| CDCP1 | CUB domain containing protein 1 | SEQ ID NOS: 2461-2462 |
| CDCP2 | CUB domain containing protein 2 | SEQ ID NOS: 2463-2464 |
| CDH1 | Cadherin 1, type 1 | SEQ ID NOS: 2465-2472 |
| CDH11 | Cadherin 11, type 2, OB-cadherin (osteoblast) | SEQ ID NOS: 2473-2482 |
| CDH13 | Cadherin 13 | SEQ ID NOS: 2483-2492 |
| CDH17 | Cadherin 17, LI cadherin (liver-intestine) | SEQ ID NOS: 2493-2497 |
| CDH18 | Cadherin 18, type 2 | SEQ ID NOS: 2498-2504 |
| CDH19 | Cadherin 19, type 2 | SEQ ID NOS: 2505-2509 |
| CDH23 | Cadherin-related 23 | SEQ ID NOS: 2510-2525 |
| CDH5 | Cadherin 5, type 2 (vascular endothelium) | SEQ ID NOS: 2526-2533 |
| CDHR1 | Cadherin-related family member 1 | SEQ ID NOS: 2534-2539 |
| CDHR4 | Cadherin-related family member 4 | SEQ ID NOS: 2540-2544 |
| CDHR5 | Cadherin-related family member 5 | SEQ ID NOS: 2545-2551 |
| CDKN2A | Cyclin-dependent kinase inhibitor 2A | SEQ ID NOS: 2552-2562 |
| CONF | Cerebral dopamine neurotrophic factor | SEQ ID NOS: 2563-2564 |
| CDON | Cell adhesion associated, oncogene regulated | SEQ ID NOS: 2565-2572 |
| CDSN | Corneodesmosin | SEQ ID NO: 2573 |
| CEACAM16 | Carcinoembryonic antigen-related cell adhesion molecule 16 | SEQ ID NOS: 2574-2575 |
| CEACAM18 | Carcinoembryonic antigen-related cell adhesion molecule 18 | SEQ ID NO: 2576 |
| CEACAM19 | Carcinoembryonic antigen-related cell adhesion molecule 19 | SEQ ID NOS: 2577-2583 |
| CEACAM5 | Carcinoembryonic antigen-related cell adhesion molecule 5 | SEQ ID NOS: 2584-2591 |
| CEACAM7 | Carcinoembryonic antigen-related cell adhesion molecule 7 | SEQ ID NOS: 2592-2594 |
| CEACAM8 | Carcinoembryonic antigen-related cell adhesion molecule 8 | SEQ ID NOS: 2595-2596 |
| CEL | Carboxyl ester lipase | SEQ ID NO: 2597 |
| CELA2A | Chymotrypsin-like elastase family, member 2A | SEQ ID NO: 2598 |
| CELA2B | Chymotrypsin-like elastase family, member 2B | SEQ ID NOS: 2599-2600 |
| CELA3A | Chymotrypsin-like elastase family, member 3A | SEQ ID NOS: 2601-2603 |
| CELA3B | Chymotrypsin-like elastase family, member 3B | SEQ ID NOS: 2604-2606 |
| CEMIP | Cell migration inducing protein, hyaluronan binding | SEQ ID NOS: 2607-2611 |
| CEP89 | Centrosomal protein 89 kDa | SEQ ID NOS: 2612-2617 |
| CER1 | Cerberus 1, DAN family BMP antagonist | SEQ ID NO: 2618 |
| CERCAM | Cerebral endothelial cell adhesion molecule | SEQ ID NOS: 2619-2626 |
| CERS1 | Ceramide synthase 1 | SEQ ID NOS: 2627-2631 |
| CES1 | Carboxylesterase 1 | SEQ ID NOS: 2632-2637 |
| CES3 | Carboxylesterase 3 | SEQ ID NOS: 2638-2642 |
| CES4A | Carboxylesterase 4A | SEQ ID NOS: 2643-2648 |
| CES5A | Carboxylesterase 5A | SEQ ID NOS: 2649-2656 |
| CETP | Cholesteryl ester transfer protein, plasma | SEQ ID NOS: 2657-2659 |
| CCDC108 | Coiled-coil domain containing 108 | SEQ ID NOS: 2660-2669 |
| CFB | Complement factor B | SEQ ID NOS: 2670-2674 |
| CFC1 | Cripto, FRL-1, cryptic family 1 | SEQ ID NOS: 2675-2677 |
| CFC1B | Cripto, FRL-1, cryptic family 1B | SEQ ID NOS: 2678-2680 |
| CFD | Complement factor D (adipsin) | SEQ ID NOS: 2681-2682 |
| CFDP1 | Craniofacial development protein 1 | SEQ ID NOS: 2683-2686 |
| CFH | Complement factor H | SEQ ID NOS: 2687-2689 |
| CFHR1 | Complement factor H-related 1 | SEQ ID NOS: 2690-2691 |
| CFHR2 | Complement factor H-related 2 | SEQ ID NOS: 2692-2693 |
| CFHR3 | Complement factor H-related 3 | SEQ ID NOS: 2694-2698 |
| CFHR4 | Complement factor H-related 4 | SEQ ID NOS: 2699-2702 |
| CFHR5 | Complement factor H-related 5 | SEQ ID NO: 2703 |
| CFI | Complement factor I | SEQ ID NOS: 2704-2708 |
| CFP | Complement factor properdin | SEQ ID NOS: 2709-2712 |
| CGA | Glycoprotein hormones, alpha polypeptide | SEQ ID NOS: 2713-2717 |
| CGB1 | Chorionic gonadotropin, beta polypeptide 1 | SEQ ID NOS: 2718-2719 |
| CGB2 | Chorionic gonadotropin, beta polypeptide 2 | SEQ ID NOS: 2720-2721 |
| CGB | Chorionic gonadotropin, beta polypeptide | SEQ ID NO: 2722 |
| CGB5 | Chorionic gonadotropin, beta polypeptide 5 | SEQ ID NO: 2723 |
| CGB7 | Chorionic gonadotropin, beta polypeptide 7 | SEQ ID NOS: 2724-2726 |
| CGB8 | Chorionic gonadotropin, beta polypeptide 8 | SEQ ID NO: 2727 |
| CGREF1 | Cell growth regulator with EF-hand domain 1 | SEQ ID NOS: 2728-2735 |
| CHAD | Chondroadherin | SEQ ID NOS: 2736-2738 |
| CHADL | Chondroadherin-like | SEQ ID NOS: 2739-2741 |
| CHEK2 | Checkpoint kinase 2 | SEQ ID NOS: 2742-2763 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| CHGA | Chromogranin A | SEQ ID NOS: 2764-2766 |
| CHGB | Chromogranin B | SEQ ID NOS: 2767-2768 |
| CHI3L1 | Chitinase 3-like 1 (cartilage glycoprotein-39) | SEQ ID NOS: 2769-2770 |
| CHI3L2 | Chitinase 3-like 2 | SEQ ID NOS: 2771-2784 |
| CHIA | Chitinase, acidic | SEQ ID NOS: 2785-2793 |
| CHID1 | Chitinase domain containing 1 | SEQ ID NOS: 2794-2812 |
| CHIT1 | Chitinase 1 (chitotriosidase) | SEQ ID NOS: 2813-2816 |
| CHL1 | Cell adhesion molecule L1-like | SEQ ID NOS: 2817-2825 |
| CHN1 | Chimerin 1 | SEQ ID NOS: 2826-2836 |
| CHPF | Chondroitin polymerizing factor | SEQ ID NOS: 2837-2839 |
| CHPF2 | Chondroitin polymerizing factor 2 | SEQ ID NOS: 2840-2843 |
| CHRD | Chordin | SEQ ID NOS: 2844-2849 |
| CHRDL1 | Chordin-like 1 | SEQ ID NOS: 2850-2854 |
| CHRDL2 | Chordin-like 2 | SEQ ID NOS: 2.855-2863 |
| CHRNA2 | Cholinergic receptor, nicotinic, alpha 2 (neuronal) | SEQ ID NOS: 2864-2872 |
| CHRNA5 | Cholinergic receptor, nicotinic, alpha 5 (neuronal) | SEQ ID NOS: 2873-2876 |
| CHRNB1 | Cholinergic receptor, nicotinic, beta 1 (muscle) | SEQ ID NOS: 2877-2882 |
| CHRND | Cholinergic receptor, nicotinic, delta (muscle) | SEQ ID NOS: 2883-2888 |
| CHST1 | Carbohydrate (keratan sulfate Gal-6) sulfotransferase 1 | SEQ ID NO: 2889 |
| CHST10 | Carbohydrate sulfotransferase 10 | SEQ ID NOS: 2890-2897 |
| CHST11 | Carbohydrate (chondroitin 4) sulfotransferase 11 | SEQ ID NOS: 2898-2902 |
| CHST13 | Carbohydrate (chondroitin 4) sulfotransferase 13 | SEQ ID NOS: 2903-2904 |
| CHST4 | Carbohydrate (N-acetylglucosamine 6-O) sulfotransferase 4 | SEQ ID NOS: 2905-2906 |
| CHST5 | Carbohydrate (N-acetylglucosamine 6-O) sulfotransferase 5 | SEQ ID NOS: 2907-2908 |
| CHST6 | Carbohydrate (N-acetylglucosamine 6-O) sulfotransferase 6 | SEQ ID NOS: 2909-2910 |
| CHST7 | Carbohydrate (N-acetylglucosamine 6-O) sulfotransferase 7 | SEQ ID NO: 2911 |
| CHST8 | Carbohydrate (N-acetylgalactosamine 4-0) sulfotransferase 8 | SEQ ID NOS: 2912-2915 |
| CHSY1 | Chondroitin sulfate synthase 1 | SEQ ID NOS: 2916-2917 |
| CHSY3 | Chondroitin sulfate synthase 3 | SEQ ID NO: 2918 |
| CHTF8 | Chromosome transmission fidelity factor 8 | SEQ ID NOS: 2919-2929 |
| CILP | Cartilage intermediate layer protein, nucleotide pyrophosphohydrolase | SEQ ID NO: 2930 |
| CILP2 | Cartilage intermediate layer protein 2 | SEQ ID NOS: 2931-2932 |
| CKLF | Chemokine-like factor | SEQ ID NOS: 2933-2938 |
| CKMT1A | Creatine kinase, mitochondrial 1A | SEQ ID NOS: 2939-2944 |
| CKMT1B | Creatine kinase, mitochondrial 1B | SEQ ID NOS: 2945-2954 |
| CLCA1 | Chloride channel accessory 1 | SEQ ID NOS: 2955-2956 |
| CLCF1 | Cardiotrophin-like cytokine factor 1 | SEQ ID NOS: 2957-2958 |
| CLDN15 | Claudin 15 | SEQ ID NOS: 2959-2964 |
| CLDN7 | Claudin 7 | SEQ ID NOS: 2.965-2971 |
| CLDND1 | Claudin domain containing 1 | SEQ ID NOS: 2972-2997 |
| CLEC11A | C-type lectin domain family 11, member A | SEQ ID NOS: 2998-3000 |
| CLEC16A | C-type lectin domain family 16, member A | SEQ ID NOS: 3001-3006 |
| CLEC18A | C-type lectin domain family 18, member A | SEQ ID NOS: 3007-3012 |
| CLEC18B | C-type lectin domain family 18, member B | SEQ ID NOS: 3013-3016 |
| CLEC18C | C-type lectin domain family 18, member C | SEQ ID NOS: 3017-3023 |
| CLEC19A | C-type lectin domain family 19, member A | SEQ ID NOS: 3024-3027 |
| CLEC2B | C-type lectin domain family 2, member B | SEQ ID NOS: 3028-3029 |
| CLEC3A | C-type lectin domain family 3, member A | SEQ ID NOS: 3030-3031 |
| CLEC3B | C-type lectin domain family 3, member B | SEQ ID NOS: 3032-3033 |
| CLGN | Calmegin | SEQ ID NOS: 3034-3036 |
| CLN5 | Ceroid-lipofuscinosis, neuronal 5 | SEQ ID NOS: 3037-3048 |
| CLPS | Colipase, pancreatic | SEQ ID NOS: 3049-3051 |
| CLPSL1 | Colipase-like 1 | SEQ ID NOS: 3052-3053 |
| CLPSL2 | Colipase-like 2 | SEQ ID NOS: 3054-3055 |
| CLPX | Caseinolytic mitochondrial matrix peptidase chaperone subunit | SEQ ID NOS: 3056-3058 |
| CLSTN3 | Calsyntenin 3 | SEQ ID NOS: 3059-3065 |
| CLU | Clusterin | SEQ ID NOS: 3066-3079 |
| CLUL1 | Clusterin-like 1 (retinal) | SEQ ID NOS: 3080-3087 |
| CMA1 | Chymase 1, mast cell | SEQ ID NOS: 3088-3089 |
| CMPK1 | Cytidine monophosphate (UMP-CMP) kinase 1, cytosolic | SEQ ID NOS: 3090-3093 |
| CNBD1 | Cyclic nucleotide binding domain containing 1 | SEQ ID NOS: 3094-3097 |
| CNDP1 | Carnosine dipeptidase 1 (metallopeptidase M20 family) | SEQ ID NOS: 3098-3100 |
| RQCD1 | RCD1 required for cell differentiation1 homolog (*S. pombe*) | SEQ ID NOS: 3101-3107 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| CNPY2 | Canopy FGF signaling regulator 2 | SEQ ID NOS: 3108-3112 |
| CNPY3 | Canopy FGF signaling regulator 3 | SEQ ID NOS: 3113-3114 |
| CNPY4 | Canopy FGF signaling regulator 4 | SEQ ID NOS: 3115-3117 |
| CNTFR | Ciliary neurotrophic factor receptor | SEQ ID NOS: 3118-3121 |
| CNTN1 | Contactin 1 | SEQ ID NOS: 3122-3131 |
| CNTN2 | Contactin 2 (axonal) | SEQ ID NOS: 3132-3143 |
| CNTN3 | Contactin 3 (plasmacytoma associated) | SEQ ID NO: 3144 |
| CNTN4 | Contactin 4 | SEQ ID NOS: 3145-3153 |
| CNTN5 | Contactin 5 | SEQ ID NOS: 3154-3159 |
| CNTNAP2 | Contactin associated protein-like 2 | SEQ ID NOS: 3160-3163 |
| CNTNAP3 | Contactin associated protein-like 3 | SEQ ID NOS: 3164-3168 |
| CNTNAP3B | Contactin associated protein-like 3B | SEQ ID NOS: 3169-3177 |
| COASY | CoA synthase | SEQ ID NOS: 3178-3187 |
| COCH | Cochlin | SEQ ID NOS: 3188-3199 |
| COG3 | Component of oligomeric golgi complex 3 | SEQ ID NOS: 3200-3203 |
| COL10A1 | Collagen, type X, alpha 1 | SEQ ID NOS: 3204-3207 |
| COL11A1 | Collagen, type XI, alpha 1 | SEQ ID NOS: 3208-3218 |
| COL11A2 | Collagen, type XI, alpha 2 | SEQ ID NOS: 3219-3223 |
| COL12A1 | Collagen, type XII, alpha 1 | SEQ ID NOS: 3224-3231 |
| COL14A1 | Collagen, type XIV, alpha 1 | SEQ ID NOS: 3232-3239 |
| COL15A1 | Collagen, type XV, alpha 1 | SEQ ID NOS: 3240-3241 |
| COL16A1 | Collagen, type XVI, alpha 1 | SEQ ID NOS: 3242-3246 |
| COL18A1 | Collagen, type XVIII, alpha 1 | SEQ ID NOS: 3247-3251 |
| COL19A1 | Collagen, type XIX, alpha 1 | SEQ ID NOS: 3252-3254 |
| COL1A1 | Collagen, type I, alpha 1 | SEQ ID NOS: 3255-3256 |
| COL1A2 | Collagen, type I, alpha 2 | SEQ ID NOS: 3257-3258 |
| COL20A1 | Collagen, type XX, alpha 1 | SEQ ID NOS: 3259-3262 |
| COL21A1 | Collagen, type XXI, alpha 1 | SEQ ID NOS: 3263-3268 |
| COL22A1 | Collagen, type XXII, alpha 1 | SEQ ID NOS: 3269-3271 |
| COL24A1 | Collagen, type XXIV, alpha 1 | SEQ ID NOS: 3272-3275 |
| COL26A1 | Collagen, type XXVI, alpha 1 | SEQ ID NOS: 3276-3277 |
| COL27A1 | Collagen, type XXVII, alpha 1 | SEQ ID NOS: 3278-3280 |
| COL28A1 | Collagen, type XXVIII, alpha 1 | SEQ ID NOS: 3281-3285 |
| COL2A1 | Collagen, type II, alpha 1 | SEQ ID NOS: 3286-3287 |
| COL3A1 | Collagen, type III, alpha 1 | SEQ ID NOS: 3288-3290 |
| COL4A1 | Collagen, type IV, alpha 1 | SEQ ID NOS: 3291-3293 |
| COL4A2 | Collagen, type IV, alpha 2 | SEQ ID NOS: 3294-3296 |
| COL4A3 | Collagen, type IV, alpha 3 (Goodpasture antigen) | SEQ ID NOS: 3297-3300 |
| COL4A4 | Collagen, type IV, alpha 4 | SEQ ID NOS: 3301-3302 |
| COL4A5 | Collagen, type IV, alpha 5 | SEQ ID NOS: 3303-3309 |
| COL4A6 | Collagen, type IV, alpha 6 | SEQ ID NOS: 3310-3315 |
| COL5A1 | Collagen, type V, alpha 1 | SEQ ID NOS: 3316-3318 |
| COL5A2 | Collagen, type V, alpha 2 | SEQ ID NOS: 3319-3320 |
| COL5A3 | Collagen, type V, alpha 3 | SEQ ID NO: 3321 |
| COL6A1 | Collagen, type VI, alpha 1 | SEQ ID NOS: 3322-3323 |
| COL6A2 | Collagen, type VI, alpha 2 | SEQ ID NOS: 3324-3329 |
| COL6A3 | Collagen, type VI, alpha 3 | SEQ ID NOS: 3330-3338 |
| COL6A5 | Collagen, type VI, alpha 5 | SEQ ID NOS: 3339-3343 |
| COL6A6 | Collagen, type VI, alpha 6 | SEQ ID NOS: 3344-3346 |
| COL7A1 | Collagen, type VII, alpha 1 | SEQ ID NOS: 3347-3348 |
| COL8A1 | Collagen, type VIII, alpha 1 | SEQ ID NOS: 3349-3352 |
| COL8A2 | Collagen, type VIII, alpha 2 | SEQ ID NOS: 3353-3355 |
| COL9A1 | Collagen, type IX, alpha 1 | SEQ ID NOS: 3356-3359 |
| COL9A2 | Collagen, type IX, alpha 2 | SEQ ID NOS: 3360-3363 |
| COL9A3 | Collagen, type IX, alpha 3 | SEQ ID NOS: 3364-3365 |
| COLEC10 | Colleclin sub-family member 10 (C-type lectin) | SEQ ID NO: 3366 |
| COLEC11 | Collectin sub-family member 11 | SEQ ID NOS: 3367-3376 |
| COLGALT1 | Collagen beta(1-O)galactosyltransferase 1 | SEQ ID NOS: 3377-3379 |
| COLGALT2 | Collagen beta(1-O)galactosyltransferase 2 | SEQ ID NOS: 3380-3382 |
| COLQ | Collagen-like tail subunit (single strand of homotrimer) of asymmetric acetylcholinesterase | SEQ ID NOS: 3383-3387 |
| COMP | Cartilage oligomeric matrix protein | SEQ ID NOS: 3388-3390 |
| COPS6 | COP9 signalosome subunit 6 | SEQ ID NOS: 3391-3394 |
| COQ6 | Coenzyme Q6 monooxygenase | SEQ ID NOS: 3395-3402 |
| CORT | Cortistatin | SEQ ID NO: 3403 |
| CP | Ceruloplasmin (ferroxidase) | SEQ ID NOS: 3404-3408 |
| CPA1 | Carboxypeptidase A1 (pancreatic) | SEQ ID NOS: 3409-3413 |
| CPA2 | Carboxy peptidase A2 (pancreatic) | SEQ ID NOS: 3414-3415 |
| CPA3 | Carboxypeptidase A3 (mast cell) | SEQ ID NO: 3416 |
| CPA4 | Carboxypeptidase A4 | SEQ ID NOS: 3417-3422 |
| CPA6 | Carboxypeptidase A6 | SEQ ID NOS: 3423-3425 |
| CPAMD8 | C3 and PZP-like, alpha-2-macroglobulin domain containing 8 | SEQ ID NOS: 3426-3431 |
| CPB1 | Carboxypeptidase B1 (tissue) | SEQ ID NOS: 3432-3436 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| CPB2 | Carboxypeptidase B2 (plasma) | SEQ ID NOS: 3437-3439 |
| CPE | Carboxypeptidase E | SEQ ID NOS: 3440-3444 |
| CPM | Carboxypeptidase M | SEQ ID NOS: 3445-3454 |
| CPN1 | Carboxypeptidase N, polypeptide 1 | SEQ ID NOS: 3455-3456 |
| CPN2 | Carboxypeptidase N, polypeptide 2 | SEQ ID NOS: 3457-3458 |
| CPO | Carboxypeptidase O | SEQ ID NO: 3459 |
| CPQ | Carboxypeptidase Q | SEQ ID NOS: 3460-3465 |
| CPVL | Carboxypeptidase, vitellogenic-like | SEQ ID NOS: 3466-3476 |
| CPXM1 | Carboxypeptidase X (M14 family), member 1 | SEQ ID NO: 3477 |
| CPXM2 | Carboxypeptidase X (M14 family), member 2 | SEQ ID NOS: 3478-3479 |
| CPZ | Carboxypeptidase Z | SEQ ID NOS: 3480-3483 |
| CR1L | Complement component (3b/4b) receptor 1-like | SEQ ID NOS: 3484-3485 |
| CRB2 | Crumbs family member 2 | SEQ ID NOS: 3486-3488 |
| CREG1 | Cellular repressor of E1A-stimulated genes 1 | SEQ ID NO: 3489 |
| CREG2 | Cellular repressor of E1A-stimulated genes 2 | SEQ ID NO: 3490 |
| CRELD1 | Cysteine-rich with EGF-like domains 1 | SEQ ID NOS: 3491-3496 |
| CRELD2 | Cysteine-rich with EGF-like domains 2 | SEQ ID NOS: 3497-3501 |
| CRH | Corticotropin releasing hormone | SEQ ID NO: 3502 |
| CRHBP | Corticotropin releasing hormone binding protein | SEQ ID NOS: 3503-3504 |
| CRHR1 | Corticotropin releasing hormone receptor 1 | SEQ ID NOS: 3505-3516 |
| CRHR2 | Corticotropin releasing hormone receptor 2 | SEQ ID NOS: 3517-3523 |
| CRISP1 | Cysteine-rich secretory protein 1 | SEQ ID NOS: 3524-3527 |
| CRISP2 | Cysteine-rich secretory protein 2 | SEQ ID NOS: 3528-3530 |
| CRISP3 | Cysteine-rich secretory protein 3 | SEQ ID NOS: 3531-3534 |
| CRISPLD2 | Cysteine-rich secretory protein LCCL domain containing 2 | SEQ ID NOS: 3535-3542 |
| CRLF1 | Cytokine receptor-like factor 1 | SEQ ID NOS: 3543-3544 |
| CRP | C-reactive protein, pentraxin-related | SEQ ID NOS: 3545-3549 |
| CRTAC1 | Cartilage acidic protein 1 | SEQ ID NOS: 3550-3554 |
| CRTAP | Cartilage associated protein | SEQ ID NOS: 3555-3556 |
| CRY2 | Cryptochrome circadian clock 2 | SEQ ID NOS: 3557-3560 |
| CSAD | Cysteine sulfinic acid decarboxylase | SEQ ID NOS: 3561-3573 |
| CSF1 | Colony stimulating factor 1 (macrophage) | SEQ ID NOS: 3574-3581 |
| CSF1R | Colony stimulating factor 1 receptor | SEQ ID NOS: 3582-3586 |
| CSF2 | Colony stimulating factor 2 (granulocyte-macrophage) | SEQ ID NO: 3587 |
| CSF2RA | Colony stimulating factor 2 receptor, alpha, low-affinity (granulocyte-macrophage) | SEQ ID NOS: 3588-3599 |
| CSF3 | Colony stimulating factor 3 (granulocyte) | SEQ ID NOS: 3600-3606 |
| CSGALNACT1 | Chondroitin sulfate N-acetylgalactosaminyltransferase 1 | SEQ ID NOS: 3607-3615 |
| CSH1 | Chorionic somatomammotropin hormone 1 (placental lactogen) | SEQ ID NOS: 3616-3619 |
| CSH2 | Chorionic somatomammotropin hormone 2. | SEQ ID NOS: 3620-3624 |
| CSHL1 | Chorionic somatomammotropin hormone-like 1 | SEQ ID NOS: 3625-3631 |
| CSN1S1 | Casein alpha s1 | SEQ ID NOS: 3632-3637 |
| CSN2 | Casein beta | SEQ ID NO: 3638 |
| CSN3 | Casein kappa | SEQ ID NO: 3639 |
| CST1 | Cystatin SN | SEQ ID NOS: 3640-3641 |
| CST11 | Cystatin 11 | SEQ ID NOS: 3642-3643 |
| CST2 | Cystatin SA | SEQ ID NO: 3644 |
| CST3 | Cystatin C | SEQ ID NOS: 3645-3647 |
| CST4 | Cystatin S | SEQ ID NO: 3648 |
| CST5 | Cystatin D | SEQ ID NO: 3649 |
| CST6 | Cystatin E/M | SEQ ID NO: 3650 |
| CST7 | Cystatin F (leukocystatin) | SEQ ID NO: 3651 |
| CST8 | Cystatin 8 (cystatin-related epididymal specific) | SEQ ID NOS: 3652-3653 |
| CST9 | Cystatin 9 (testatin) | SEQ ID NO: 3654 |
| CST9L | Cystatin 9-like | SEQ ID NO: 3655 |
| CSTL1 | Cystatin-like 1 | SEQ ID NOS: 3656-3658 |
| CT55 | Cancer/testis antigen 55 | SEQ ID NOS: 3659-3660 |
| CTBS | Chitobiase, di-N-acetyl- | SEQ ID NOS: 3661-3663 |
| CTGF | Connective tissue growth factor | SEQ ID NO: 3664 |
| CTHRC1 | Collagen triple helix repeat containing 1 | SEQ ID NOS: 3665-3668 |
| CTLA4 | Cytotoxic T-lymphocyte-associated protein 4 | SEQ ID NOS: 3669-3672 |
| CTNS | Cystinosin, lysosomal cystine transporter | SEQ ID NOS: 3673-3680 |
| CTRB1 | Chymotrypsinogen B1 | SEQ ID NOS: 3681-3683 |
| CTRB2 | Chymotrypsinogen B2 | SEQ ID NOS: 3684-3687 |
| CTRC | Chymotrypsin C (caldecrin) | SEQ ID NOS: 3688-3689 |
| CTRL | Chymotrypsin-like | SEQ ID NOS: 3690-3692 |
| CTSA | Cathepsin A | SEQ ID NOS: 3693-3701 |
| CTSB | Cathepsin B | SEQ ID NOS: 3702-3726 |
| CTSC | Cathepsin C | SEQ ID NOS: 3727-3731 |
| CTSD | Cathepsin D | SEQ ID NOS; 3732-3742 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| CTSE | Cathepsin E | SEQ ID NOS: 3743-3744 |
| CTSF | Cathepsin F | SEQ ID NOS: 3745-3748 |
| CTSG | Cathepsin G | SEQ ID NO: 3749 |
| CTSH | Cathepsin H | SEQ ID NOS: 3750-3755 |
| CTSK | Cathepsin K | SEQ ID NOS: 3756-3757 |
| CTSL | Cathepsin L | SEQ ID NOS: 3758-3760 |
| CTSO | Cathepsin O | SEQ ID NO: 3761 |
| CTSS | Cathepsin S | SEQ ID NOS: 3762-3766 |
| CTSV | Cathepsin V | SEQ ID NOS: 3767-3768 |
| CTSW | Cathepsin W | SEQ ID NOS: 3769-3771 |
| CTSZ | Cathepsin Z | SEQ ID NO: 3772 |
| CUBN | Cubilin (intrinsic factor-cobalamin receptor) | SEQ ID NOS: 3773-3776 |
| CUTA | CutA divalent cation tolerance homolog (*E. coli*) | SEQ ID NOS: 3777-3786 |
| CX3CL1 | Chemokine (C-X3-C motif) ligand 1 | SEQ ID NOS: 3787-3790 |
| CXADR | Coxsackie virus and adenovirus receptor | SEQ ID NOS: 3791-3795 |
| CXCL1 | Chemokine (C-X-C motif) ligand 1 (melanoma growth stimulating activity, alpha) | SEQ ID NO: 3796 |
| CXCL10 | Chemokine (C-X-C motif) ligand 10 | SEQ ID NO: 3797 |
| CXCL11 | Chemokine (C-X-C motif) ligand 11 | SEQ ID NOS: 3798-3799 |
| CXCL12 | Chemokine (C-X-C motif) ligand 12 | SEQ ID NOS: 3800-3805 |
| CXCL13 | Chemokine (C-X-C motif) ligand 13 | SEQ ID NO: 3806 |
| CXCL14 | Chemokine (C-X-C motif) ligand 14 | SEQ ID NOS: 3807-3808 |
| CXCL17 | Chemokine (C-X-C motif) ligand 17 | SEQ ID NOS: 3809-3810 |
| CXCL2 | Chemokine (C-X-C motif) ligand 2 | SEQ ID NO: 3811 |
| CXCL3 | Chemokine (C-X-C motif) ligand 3 | SEQ ID NO: 3812 |
| CXCL5 | Chemokine (C-X-C motif) ligand 5 | SEQ ID NO: 3813 |
| CXCL6 | Chemokine (C-X-C motif) ligand 6 | SEQ ID NOS: 3814-3815 |
| CXCL8 | Chemokine (C-X-C motif) ligand 8 | SEQ ID NOS: 3816-3817 |
| CXCL9 | Chemokine (C-X-C motif) ligand 9 | SEQ ID NO: 3818 |
| CXorf36 | Chromosome X open reading frame 36 | SEQ ID NOS: 3819-3820 |
| CYB5D2 | Cytochrome b5 domain containing 2 | SEQ ID NOS: 3821-3824 |
| CYHR1 | Cysteine/histidine-rich 1 | SEQ ID NOS: 3825-3832 |
| CYP17A1 | Cytochrome P450, family 17, subfamily A, polypeptide 1 | SEQ ID NOS: 3833-3837 |
| CYP20A1 | Cytochrome P450, family 20, subfamily A, polypeptide 1 | SEQ ID NOS: 3838-3844 |
| CYP21A2 | Cytochrome P450, family 21, subfamily A, polypeptide 2 | SEQ ID NOS: 3845-3852 |
| CYP26B1 | Cytochrome P450, family 26, subfamily B, polypeptide 1 | SEQ ID NOS: 3853-3857 |
| CYP2A6 | Cytochrome P450, family 2, subfamily A, polypeptide 6 | SEQ ID NOS: 3858-3859 |
| CYP2A7 | Cytochrome P450, family 2, subfamily A, polypeptide 7 | SEQ ID NOS: 3860-3862 |
| CYP2B6 | Cytochrome P450, family 2, subfamily B, polypeptide 6 | SEQ ID NOS: 3863-3866 |
| CYP2C18 | Cytochrome P450, family 2, subfamily C, polypeptide 18 | SEQ ID NOS: 3867-3868 |
| CYP2C19 | Cytochrome P450, family 2, subfamily C, polypeptide 19 | SEQ ID NOS: 3869-3870 |
| CYP2C8 | Cytochrome P450, family 2, subfamily C, polypeptide 8 | SEQ ID NOS: 3871-3878 |
| CYP2C9 | Cytochrome P450, family 2, subfamily C, polypeptide 9 | SEQ ID NOS: 3879-3881 |
| CYP2E1 | Cytochrome P450, family 2, subfamily E, polypeptide 1 | SEQ ID NOS: 3882-3887 |
| CYP2F1 | Cytochrome P450, family 2, subfamily F, polypeptide 1 | SEQ ID NOS: 3888-3891 |
| CYP2J2 | Cytochrome P450, family 2, subfamily J, polypeptide 2 | SEQ ID NO: 3892 |
| CYP2R1 | Cytochrome P450, family 2, subfamily R, polypeptide 1 | SEQ ID NOS: 3893-3898 |
| CYP2S1 | Cytochrome P450, family 2, subfamily S, polypeptide 1 | SEQ ID NOS: 3899-3904 |
| CYP2W1 | Cytochrome P450, family 2, subfamily W, polypeptide 1 | SEQ ID NOS: 3905-3907 |
| CYP46A1 | Cytochrome P450, family 46, subfamily A, polypeptide 1 | SEQ ID NOS: 3908-3912 |
| CYP4F11 | Cytochrome P450, family 4, subfamily F, polypeptide 11 | SEQID NOS: 3913-3917 |
| CYP4F2 | Cytochrome P450, family 4, subfamily F, polypeptide 2 | SEQ ID NOS: 3918-3922 |
| CYR61 | Cysteine-rich, angiogenic inducer, 61 | SEQ ID NO: 3923 |
| CYTL1 | Cytokine-like 1 | SEQ ID NOS: 3924-3926 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| D2HGDH | D-2-hydroxyglutarate dehydrogenase | SEQ ID NOS: 3927-3935 |
| DAG1 | Dystroglycan 1 (dystrophin-associated glycoprotein 1) | SEQ ID NOS: 3936-3950 |
| DAND5 | DAN domain family member 5, BMP antagonist | SEQ ID NOS: 3951-3952 |
| DAO | D-amino-acid oxidase | SEQ ID NOS: 3953-3958 |
| DAZAP2 | DAZ associated protein 2 | SEQ ID NOS: 3959-3967 |
| DBH | Dopamine beta-hydroxylase (dopamine beta-monooxygenase) | SEQ ID NOS: 3968-3969 |
| DBNL | Drebrin-like | SEQ ID NOS: 3970-3987 |
| DCD | Dermcidin | SEQ ID NOS: 3988-3990 |
| DCN | Decorin | SEQ ID NOS: 3991-4009 |
| DD1AS | DNA damage-induced apoptosis suppressor | SEQ ID NOS: 4010-4019 |
| DDOST | Dolichyl-diphosphooligosaccharide--protein glycosyltransferase subunit (non-catalytic) | SEQ ID NOS: 4020-4023 |
| DDR1 | Discoidin domain receptor tyrosine kinase 1 | SEQ ID NOS: 4024-4069 |
| DDR2 | Discoidin domain receptor tyrosine kinase 2 | SEQ ID NOS: 4070-4075 |
| DDT | D-dopachrome tautomerase | SEQ ID NOS: 4076-4081 |
| DDX17 | DEAD (Asp-Glu-Ala-Asp) box helicase 17 | SEQ ID NOS: 4082-4086 |
| DDX20 | DEAD (Asp-Glu-Ala-Asp) box polypeptide 20 | SEQ ID NOS: 4087-4089 |
| DDX25 | DEAD (Asp-Glu-Ala-Asp) box helicase 25 | SEQ ID NOS: 4090-4096 |
| DDX28 | DEAD (Asp-Glu-Ala-Asp) box polypeptide 28 | SEQ ID NO: 4097 |
| DEAE1 | DEAF1 transcription factor | SEQ ID NOS: 4098-4100 |
| DEF8 | Differentially expressed in FDCP 8 homolog (mouse) | SEQ ID NOS: 4101-4120 |
| DEFA1 | Defensin, alpha 1 | SEQ ID NOS: 4121-4122 |
| DEFA1B | Defensin, alpha 1B | SEQ ID NO: 4123 |
| DEFA3 | Defensin, alpha 3, neutrophil-specific | SEQ ID NO: 4124 |
| DEFA4 | Defensin, alpha 4, corticostatin | SEQ ID NO: 4125 |
| DEFA5 | Defensin, alpha 5, Paneth cell-specific | SEQ ID NO: 4126 |
| DEFA6 | Defensin, alpha 6, Paneth cell-specific | SEQ ID NO: 4127 |
| DEFB1 | Defensin, beta 1 | SEQ ID NO: 4128 |
| DEFB103A | Defensin, beta 103A | SEQ ID NO: 4129 |
| DEFB103B | Defensin, beta 103B | SEQ ID NO: 4130 |
| DEFB104A | Defensin, beta 104A | SEQ ID NO: 4131 |
| DEFB104B | Defensin, beta 104B | SEQ ID NO: 4132 |
| DEFB105A | Defensin, beta 105A | SEQ ID NO: 4133 |
| DEFB105B | Defensin, beta 105B | SEQ ID NO: 4134 |
| DEFB106A | Defensin, beta 106A | SEQ ID NO: 4135 |
| DEFB106B | Defensin, beta 106B | SEQ ID NO: 4136 |
| DEFB107A | Defensin, beta 107A | SEQ ID NO: 4137 |
| DEFB107B | Defensin, beta 107B | SEQ ID NO: 4138 |
| DEFB108B | Defensin, beta 108B | SEQ ID NO: 4139 |
| DEFB110 | Defensin, beta 110 | SEQ ID NOS: 4140-4141 |
| DEFB113 | Defensin, beta 113 | SEQ ID NO: 4142 |
| DEFB114 | Defensin, beta 114 | SEQ ID NO: 4143 |
| DEFB115 | Defensin, beta 115 | SEQ ID NO: 4144 |
| DEFB116 | Defensin, beta 116 | SEQ ID NO: 4145 |
| DEFB118 | Defensin, beta 118 | SEQ ID NO: 4146 |
| DEFB119 | Defensin, beta 119 | SEQ ID NOS: 4147-4149 |
| DEFB121 | Defensin, beta 121 | SEQ ID NO: 4150 |
| DEEB123 | Defensin, beta 123 | SEQ ID NO: 4151 |
| DEFB124 | Defensin, beta 124 | SEQ ID NO: 4152 |
| DEFB125 | Defensin, beta 125 | SEQ ID NO: 4153 |
| DEFB126 | Defensin, beta 126 | SEQ ID NO: 4154 |
| DEFB127 | Defensin, beta 127 | SEQ ID NO: 4155 |
| DEEB128 | Defensin, beta 128 | SEQ ID NO: 4156 |
| DEFB129 | Defensin, beta 129 | SEQ ID NO: 4157 |
| DEFB130 | Defensin, beta 130 | SEQ ID NO: 4158 |
| RP11-1236K1.1 | | SEQ ID NO: 4159 |
| DEFB131 | Defensin, beta 131 | SEQ ID NO: 4160 |
| CTD-2313N18.7 | | SEQ ID NO: 4161 |
| DEFB132 | Defensin, beta 132 | SEQ ID NO: 4162 |
| DEFB133 | Defensin, beta 133 | SEQ ID NO: 4163 |
| DEFB134 | Defensin, beta 134 | SEQ ID NOS: 4164-4165 |
| DEFB135 | Defensin, beta 135 | SEQ ID NO: 4166 |
| DEEB136 | Defensin, beta 136 | SEQ ID NO: 4167 |
| DEFB4A | Defensin, beta 4A | SEQ ID NO: 4168 |
| DEFB4B | Defensin, beta 4B | SEQ ID NO: 4169 |
| C10orf10 | Chromosome 10 open reading frame 10 | SEQ ID NOS: 4170-4171 |
| DGCR2 | DiGeorge syndrome critical region gene 2 | SEQ ID NOS: 4172-4175 |
| DHH | Desert hedgehog | SEQ ID NO: 4176 |
| DHRS4 | Dehydrogenase/reductase (SDR family) member 4 | SEQ ID NOS: 4177-4184 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| DHRS4L2 | Dehydrogenase/reductase (SDR family) member 4 like 2 | SEQ ID NOS: 4185-4194 |
| DHRS7 | Dehydrogenase/reductase (SDR family) member 7 | SEQ ID NOS: 4195-4202 |
| DHRS7C | Dehydrogenase/reductase (SDR family) member 7C | SEQ ID NOS: 4203-4205 |
| DHRS9 | Dehydrogenase/reductase (SDR family) member 9 | SEQ ID NOS: 4206-4213 |
| DHRSX | Dehydrogenase/reductase (SDR family) X-linked | SEQ ID NOS: 4214-4218 |
| DHX29 | DEAH (Asp-Glu-Ala-His) box polypeptide 29 | SEQ ID NOS: 4219-4221 |
| DHX30 | DEAH (Asp-Glu-Ala-His) box helicase 30 | SEQ ID NOS: 4222-4229 |
| DHX8 | DEAH (Asp-Glu-Ala-His) box polypeptide 8 | SEQ ID NOS: 4230-4234 |
| DIO2 | Deiodinase, iodothyronine, type II | SEQ ID NOS: 4235-4244 |
| DIXDC1 | DIX domain containing 1 | SEQ ID NOS: 4245-4248 |
| DKK1 | Dickkopf WNT signaling pathway inhibitor 1 | SEQ ID NO: 4249 |
| DKK2 | Dickkopf WNT signaling pathway inhibitor 2 | SEQ ID NOS: 4250-4252 |
| DKK3 | Dickkopf WNT signaling pathway inhibitor 3 | SEQ ID NOS: 4253-4258 |
| DKK4 | Dickkopf WNT signaling pathway inhibitor 4 | SEQ ID NO: 4259 |
| DKKL1 | Dickkopf-like 1 | SEQ ID NOS: 4260-4265 |
| DLG4 | Discs, large homolog 4 (*Drosophila*) | SEQ ID NOS: 4266-4274 |
| DLK1 | Delta-like 1 homolog (*Drosophila*) | SEQ ID NOS: 4275-4278 |
| DLL1 | Delta-like 1 (*Drosophila*) | SEQ ID NOS: 4279-4280 |
| DLL3 | Delta-like 3 (*Drosophila*) | SEQ ID NOS: 4281-4283 |
| DMBT1 | Deleted in malignant brain tumors 1 | SEQ ID NOS: 4284-4290 |
| DMKN | Dermokine | SEQ ID NOS: 4291-4337 |
| DMP1 | Dentin matrix acidic phosphoprotein 1 | SEQ ID NOS: 4338-4339 |
| DMRTA2 | DMRT-like family A2 | SEQ ID NOS: 4340-4341 |
| DNAAF5 | Dynein, axonemal, assembly factor 5 | SEQ ID NOS: 4342-4345 |
| DNAH14 | Dynein, axonemal, heavy chain 14 | SEQ ID NOS: 4346-4360 |
| DNAJB11 | DnaJ (Hsp40) homolog, subfamily B, member 11 | SEQ ID NOS: 4361-4362 |
| DNAJB9 | DnaJ (Hsp40) homolog, subfamily B, member 9 | SEQ ID NO: 4363 |
| DNAJC25-GNG10 | DNAJC25-GNG10 readthrough | SEQ ID NO: 4364 |
| DNAJC3 | DnaJ (Hsp40) homolog, subfamily C, member 3 | SEQ ID NOS: 4365-4366 |
| DNASE1 | Deoxyribonuclease I | SEQ ID NOS: 4367-4377 |
| DNASE1L1 | Deoxyribonuclease I-like 1 | SEQ ID NOS: 4378-4388 |
| DNASE1L2 | Deoxyribonuclease I-like 2 | SEQ ID NOS: 4389-4394 |
| DNASE1L3 | Deoxyribonuclease I-like 3 | SEQ ID NOS: 4395-4400 |
| DNASE2 | Deoxyribonuclease II, lysosomal | SEQ ID NOS: 4401-4402 |
| DNASE2B | Deoxyribonuclease II beta | SEQ ID NOS: 4403-4404 |
| DPEP1 | Dipeptidase 1 (renal) | SEQ ID NOS: 4405-4409 |
| DPEP2 | Dipeptidase 2 | SEQ ID NOS: 4410-4416 |
| DPEP3 | Dipeptidase 3 | SEQ ID NO: 4417 |
| DPF3 | D4, zinc and double PHD fingers, family 3 | SEQ ID NOS: 4418-4424 |
| DPP4 | Dipeptidyl-peptidase 4 | SEQ ID NOS: 4425-4429 |
| DPP7 | Dipeptidyl-peptidase 7 | SEQ ID NOS: 4430-4435 |
| DPT | Dermatopontin | SEQ ID NO: 4436 |
| DRAXIN | Dorsal inhibitory axon guidance protein | SEQ ID NO: 4437 |
| DSE | Dermatan sulfate epimerase | SEQ ID NOS: 4438-4446 |
| DSG2 | Desmoglein 2 | SEQ ID NOS: 4447-4448 |
| DSPP | Dentin sialophosphoprotein | SEQ ID NOS: 4449-4450 |
| DST | Dystonin | SEQ ID NOS: 4451-4469 |
| DUOX1 | Dual oxidase 1 | SEQ ID NOS: 4470-4474 |
| DYNLT3 | Dynein, light chain, Tctex-type 3 | SEQ ID NOS: 4475-4477 |
| E2F5 | E2F transcription factor 5, p130-binding | SEQ ID NOS: 4478-4484 |
| EBAG9 | Estrogen receptor binding site associated, antigen, 9 | SEQ ID NOS: 4485-4493 |
| EBI3 | Epstein-Barr virus induced 3 | SEQ ID NO: 4494 |
| ECHDC1 | Ethylmalonyl-CoA decarboxylase 1 | SEQ ID NOS: 4495-4513 |
| ECM1 | Extracellular matrix protein 1 | SEQ ID NOS: 4514-4516 |
| ECM2 | Extracellular matrix protein 2, female organ and adipocyte specific | SEQ ID NOS: 4517-4520 |
| ECSIT | ECSIT signalling integrator | SEQ ID NOS: 4521-4532 |
| EDDM3A | Epididymal protein 3A | SEQ ID NO: 4533 |
| EDDM3B | Epididymal protein 3B | SEQ ID NO: 4534 |
| EDEM2 | ER degradation enhancer, mannosidase alpha-like 2 | SEQ ID NOS: 4535-4536 |
| EDEM3 | ER degradation enhancer, mannosidase alpha-like 3 | SEQ ID NOS: 4537-4539 |
| EDIL3 | EGF-like repeats and discoidin I-like domains 3 | SEQ ID NOS: 4540-4541 |
| EDN1 | Endothelin 1 | SEQ ID NO: 4542 |
| EDN2 | Endothelin 2 | SEQ ID NO: 4543 |
| EDN3 | Endothelin 3 | SEQ ID NOS: 4544-4549 |
| EDNRB | Endothelin receptor type B | SEQ ID NOS: 4550-4558 |
| EFEMP1 | EGF containing fibulin-like extracellular matrix protein 1 | SEQ ID NOS: 4559-4569 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| EFEMP2 | EGF containing fibulin-like extracellular matrix protein 2 | SEQ ID NOS: 4570-4581 |
| EFNA1 | Ephrin-A1 | SEQ ID NOS: 4582-4583 |
| EFNA2 | Ephrin-A2 | SEQ ID NO: 4584 |
| EFNA4 | Ephrin-A4 | SEQ ID NOS: 4585-4587 |
| EGFL6 | EGF-like-domain, multiple 6 | SEQ ID NOS: 4588-4589 |
| EGFL7 | EGF-like-domain, multiple 7 | SEQ ID NOS: 4590-4594 |
| EGFL8 | EGF-like-domain, multiple 8 | SEQ ID NOS: 4595-4597 |
| EGFLAM | EGF-like, fibronectin type III and laminin G domains | SEQ ID NOS: 4598-4606 |
| EGFR | Epidermal growth factor receptor | SEQ ID NOS: 4607-4614 |
| EHBP1 | EH domain binding protein 1 | SEQ ID NOS: 4615-4626 |
| EHF | Ets homologous factor | SEQ ID NOS: 4627-4636 |
| EHMT1 | Euchromatic histone-lysine N-methyltransferase 1 | SEQ ID NOS: 4637-4662 |
| EHMT2 | Euchromatic histone-lysine N-methyltransferase 2 | SEQ ID NOS: 4663-4667 |
| EIF2AK1 | Eukaryotic translation initiation factor 2-alpha kinase 1 | SEQ ID NOS: 4668-4671 |
| ELANE | Elastase, neutrophil expressed | SEQ ID NOS: 4672-4673 |
| ELN | Elastin | SEQ ID NOS: 4674-4696 |
| ELP2 | Elongator acetyltransferase complex subunit 2 | SEQ ID NOS: 4697-4709 |
| ELSPBP1 | Epididymal sperm binding protein 1 | SEQ ID NOS: 4710-4715 |
| EMC1 | ER membrane protein complex subunit 1 | SEQ ID NOS: 4716-4722 |
| EMC10 | ER membrane protein complex subunit 10 | SEQ ID NOS: 4723-4729 |
| EMC9 | ER membrane protein complex subunit 9 | SEQ ID NOS: 4730-4733 |
| EMCN | Endomucin | SEQ ID NOS: 4734-4738 |
| EMID1 | EMI domain containing 1 | SEQ ID NOS: 4739-4745 |
| EMILIN1 | Elastin microfibril interfacer 1 | SEQ ID NOS: 4746-4747 |
| EMILIN2 | Elastin microfibril interfacer 2 | SEQ ID NO: 4748 |
| EMILIN3 | Elastin microfibril interfacer 3 | SEQ ID NO: 4749 |
| ENAM | Enamelin | SEQ ID NO: 4750 |
| ENDOG | Endonuclease G | SEQ ID NO: 4751 |
| ENDOU | Endonuclease, polyU-specific | SEQ ID NOS: 4752-4754 |
| ENHO | Energy homeostasis associated | SEQ ID NO: 4755 |
| ENO4 | Enolase family member 4 | SEQ ID NOS: 4756-4760 |
| ENPP6 | Ectonucleotide pyrophosphatase/phosphodiesterase 6 | SEQ ID NOS: 4761-4762 |
| ENPP7 | Ectonucleotide pyrophosphatase/phosphodiesterase 7 | SEQ ID NOS: 4763-4764 |
| ENTPD5 | Ectonucleoside triphosphate diphosphohydrolase 5 | SEQ ID NOS: 4765-4769 |
| ENTPD8 | Ectonucleoside triphosphate diphosphohydrolase 8 | SEQ ID NOS: 4770-4773 |
| EOGT | EGF domain-specific O-linked N-acetylglucosamine (GlcNAc) transferase | SEQ ID NOS: 4774-4781 |
| EPCAM | Epithelial cell adhesion molecule | SEQ ID NOS: 4782-4785 |
| EPDR1 | Ependymin related 1 | SEQ ID NOS: 4786-4789 |
| EPGN | Epithelial mitogen | SEQ ID NOS: 4790-4798 |
| EPHA10 | EPH receptor A10 | SEQ ID NOS: 4799-4806 |
| EPHA3 | EPH receptor A3 | SEQ ID NOS: 4807-4809 |
| EPHA4 | EPH receptor A4 | SEQ ID NOS: 4810-4819 |
| EPHA7 | EPH receptor A7 | SEQ ID NOS: 4820-4821 |
| EPHA8 | EPH receptor A8 | SEQ ID NOS: 4822-4823 |
| EPHB2 | EPH receptor B2 | SEQ ID NOS: 4824-4828 |
| EPHB4 | EPH receptor B4 | SEQ ID NOS: 4829-4831 |
| EPHX3 | Epoxide hydrolase 3 | SEQ ID NOS: 4832-4835 |
| EPO | Erythropoietin | SEQ ID NO: 4836 |
| EPPIN | Epididymal peptidase inhibitor | SEQ ID NOS: 4837-4839 |
| EPPIN-WFDC6 | EPPIN-WFDC6 readthrough | SEQ ID NO: 4840 |
| EPS15 | Epidermal growth factor receptor pathway substrate 15 | SEQ ID NOS: 4841-4843 |
| EPS8L1 | EPS8-like 1 | SEQ ID NOS: 4844-4849 |
| EPX | Eosinophil peroxidase | SEQ ID NO: 4850 |
| EPYC | Epiphycan | SEQ ID NOS: 4851-4852 |
| EQTN | Equatorin, sperm acrosome associated | SEQ ID NOS: 4853-4855 |
| ERAP1 | Endoplasmic reticulum aminopeptidase 1 | SEQ ID NOS: 4856-4861 |
| ERAP2 | Endoplasmic reticulum aminopeptidase 2 | SEQ ID NOS: 4862-4869 |
| ERBB3 | Erb-b2 receptor tyrosine kinase 3 | SEQ ID NOS: 4870-4883 |
| FAM132B | Family with sequence similarity 132, member B | SEQ ID NOS: 4884-4886 |
| ERLIN1 | ER lipid raft associated 1 | SEQ ID NOS: 4887-4889 |
| ERLIN2 | ER lipid raft associated 2 | SEQ ID NOS: 4890-4898 |
| ERN1 | Endoplasmic reticulum to nucleus signaling 1 | SEQ ID NOS: 4899-4900 |
| ERN2 | Endoplasmic reticulum to nucleus signaling 2 | SEQ ID NOS: 4901-4905 |
| ERO1A | Endoplasmic reticulum oxidoreductase alpha | SEQ ID NOS: 4906-4912 |
| ERO1B | Endoplasmic reticulum oxidoreductase beta | SEQ ID NOS: 4913-4915 |
| ERP27 | Endoplasmic reticulum protein 27 | SEQ ID NOS: 4916-4917 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| ERP29 | Endoplasmic reticulum protein 29 | SEQ ID NOS: 4918-4921 |
| ERP44 | Endoplasmic reticulum protein 44 | SEQ ID NO: 4922 |
| ERV3-1 | Endogenous retrovirus group 3, member 1 | SEQ ID NO: 4923 |
| ESM1 | Endothelial cell-specific molecule 1 | SEQ ID NOS: 4924-4926 |
| ESRP1 | Epithelial splicing regulatory protein 1 | SEQ ID NOS: 4927-4935 |
| EXOG | Endo/exomiclease (5'-3'), endonuclease G-like | SEQ ID NOS: 4936-4949 |
| EXTL1 | Exostosin-like glycosyltransferase 1 | SEQ ID NO: 4950 |
| EXTL2 | Exostosin-like glycosyltransferase 2 | SEQ ID NOS: 4951-4955 |
| F10 | Coagulation factor X | SEQ ID NOS: 4956-4959 |
| F11 | Coagulation factor XI | SEQ ID NOS: 4960-4964 |
| F12 | Coagulation factor XII (Hageman factor) | SEQ ID NO: 4965 |
| F13B | Coagulation factor XIII, B polypeptide | SEQ ID NO: 4966 |
| F2 | Coagulation factor II (thrombin) | SEQ ID NOS: 4967-4969 |
| F2R | Coagulation factor II (thrombin) receptor | SEQ ID NOS: 4970-4971 |
| F2RL3 | Coagulation factor II (thrombin) receptor-like 3 | SEQ ID NOS: 4972-4973 |
| F5 | Coagulation factor V (proaccelerin, labile factor) | SEQ ID NOS: 4974-4975 |
| F7 | Coagulation factor VII (serum prothrombin conversion accelerator) | SEQ ID NOS: 4976-4979 |
| F8 | Coagulation factor VIII, procoagulant component | SEQ ID NOS: 4980-4985 |
| F9 | Coagulation factor IX | SEQ ID NOS: 4986-4987 |
| FABP6 | Fatty acid binding protein 6, ileal | SEQ ID NOS: 4988-4990 |
| FAM107B | Family with sequence similarity 107, member B | SEQ ID NOS: 4991-5012 |
| FAM131A | Family with sequence similarity 131, member A | SEQ ID NOS: 5013-5021 |
| FAM171A1 | Family with sequence similarity 171, member A1 | SEQ ID NOS: 5022-5023 |
| FAM171B | Family with sequence similarity 171, member B | SEQ ID NOS: 5024-5025 |
| FAM172A | Family with sequence similarity 172, member A | SEQ ID NOS: 5026-5030 |
| FAM177A1 | Family with sequence similarity 177, member A1 | SEQ ID NOS: 5031-5040 |
| FAM180A | Family with sequence similarity 180, member A | SEQ ID NOS: 5041-5043 |
| FAM189A1 | Family with sequence similarity 189, member A1 | SEQ ID NOS: 5044-5045 |
| FAM198A | Family with sequence similarity 198, member A | SEQ ID NOS: 5046-5048 |
| FAM19A1 | Family with sequence similarity 19 (chemokine (C-C motif)-like), member A1 | SEQ ID NOS: 5049-5051 |
| FAM19A2 | Family with sequence similarity 19 (chemokine (C-C motif)-like), member A2 | SEQ ID NOS: 5052-5059 |
| FAM19A3 | Family with sequence similarity 19 (chemokine (C-C motif)-like), member A3 | SEQ ID NOS: 5060-5061 |
| FAM19A4 | Family with sequence similarity 19 (chemokine (C-C motif)-like), member A4 | SEQ ID NOS: 5062-5064 |
| FAM19A5 | Family with sequence similarity 19 (chemokine (C-C motif)-like), member A5 | SEQ ID NOS: 5065-5068 |
| FAM20A | Family with sequence similarity 20, member A | SEQ ID NOS: 5069-5072 |
| FAM20C | Family with sequence similarity 20, member C | SEQ ID NO: 5073 |
| FAM213A | Family with sequence similarity 213, member A | SEQ ID NOS: 5074-5079 |
| FAM46B | Family with sequence similarity 46, member B | SEQ ID NO: 5080 |
| FAM57A | Family with sequence similarity 57, member A | SEQ ID NOS: 5081-5086 |
| FAM78A | Family with sequence similarity 78, member A | SEQ ID NOS: 5087-5089 |
| FAM96A | Family with sequence similarity 96, member A | SEQ ID NOS: 5090-5094 |
| FAM9B | Family with sequence similarity 9, member B | SEQ ID NOS: 5095-5098 |
| FAP | Fibroblast activation protein, alpha | SEQ ID NOS: 5099-5105 |
| FAS | Fas cell surface death receptor | SEQ ID NOS: 5106-5115 |
| FAT1 | FAT atypical cadherin 1 | SEQ ID NOS: 5116-5122 |
| FBLN1 | Fibulin 1 | SEQ ID NOS: 5123-5135 |
| FBLN2 | Fibulin 2 | SEQ ID NOS: 5136-5141 |
| FBLN5 | Fibulin 5 | SEQ ID NOS: 5142-5147 |
| FBLN7 | Fibulin 7 | SEQ ID NOS: 5148-5153 |
| FBN1 | Fibrillin 1 | SEQ ID NOS: 5154-5157 |
| FBN2 | Fibrillin 2 | SEQ ID NOS: 5158-5163 |
| FBN3 | Fibrillin 3 | SEQ ID NOS: 5164-5168 |
| FBXW7 | F-box and WD repeat domain containing 7, E3 ubiquitin protein ligase | SEQ ID NOS: 5169-5179 |
| FCAR | Fc fragment of IgA receptor | SEQ ID NOS: 5180-5189 |
| FCGBP | Fc fragment of IgG binding protein | SEQ ID NOS: 5190-5192 |
| FCGR1B | Fc fragment of IgG, high affinity Ib, receptor (CD64) | SEQ ID NOS: 5193-5198 |
| FCGR3A | Fc fragment of IgG, low affinity IIIa, receptor (CD16a) | SEQ ID NOS: 5199-5205 |
| FCGRT | Fc fragment of IgG, receptor, transporter, alpha | SEQ ID NOS: 5206-5216 |
| FCMR | Fc fragment of IgM receptor | SEQ ID NOS: 5217-5223 |
| FCN1 | Ficolin (collagen/fibrinogen domain containing) 1 | SEQ ID NOS: 5224-5225 |
| FCN2 | Ficolin (collagen/fibrinogen domain containing lectin) 2 | SEQ ID NOS: 5226-5227 |
| FCN3 | Ficolin (collagen/fibrinogen domain containing) 3 | SEQ ID NOS: 5228-5229 |
| FCRL1 | Fc receptor-like 1 | SEQ ID NOS: 5230-5232 |
| FCRL3 | Fc receptor-like 3 | SEQ ID NOS: 5233-5238 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| FCRL5 | Fc receptor-like 5 | SEQ ID NOS: 5239-5241 |
| FCRLA | Fc receptor-like A | SEQ ID NOS: 5242-5253 |
| FCRLB | Fc receptor-like B | SEQ ID NOS: 5254-5258 |
| FDCSP | Follicular dendritic cell secreted protein | SEQ ID NO: 5259 |
| FETUB | Fetuin B | SEQ ID NOS: 5260-5266 |
| FGA | Fibrinogen alpha chain | SEQ ID NOS: 5267-5269 |
| FGB | Fibrinogen beta chain | SEQ ID NOS: 5270-5272 |
| FGF10 | Fibroblast growth factor 10 | SEQ ID NOS: 5273-5274 |
| FGF17 | Fibroblast growth factor 17 | SEQ ID NOS: 5275-5276 |
| FGF18 | Fibroblast growth factor 18 | SEQ ID NO: 5277 |
| FGF19 | Fibroblast growth factor 19 | SEQ ID NO: 5278 |
| FGF21 | Fibroblast growth factor 21 | SEQ ID NOS: 5279-5280 |
| FGF22 | Fibroblast growth factor 22 | SEQ ID NOS: 5281-5282 |
| FGF23 | Fibroblast growth factor 23 | SEQ ID NO: 5283 |
| FGF3 | Fibroblast growth factor 3 | SEQ ID NO: 5284 |
| FGF4 | Fibroblast growth factor 4 | SEQ ID NO: 5285 |
| FGF5 | Fibroblast growth factor 5 | SEQ ID NOS: 5286-5288 |
| FGF7 | Fibroblast growth factor 7 | SEQ ID NOS: 5289-5293 |
| FGF8 | Fibroblast growth factor 8 (androgen-induced) | SEQ ID NOS: 5294-5299 |
| FGFBP1 | Fibroblast growth factor binding protein 1 | SEQ ID NO: 5300 |
| FGFBP2 | Fibroblast growth factor binding protein 2 | SEQ ID NO: 5301 |
| FGFBP3 | Fibroblast growth factor binding protein 3 | SEQ ID NO: 5302 |
| FGFR1 | Fibroblast growth factor receptor 1 | SEQ ID NOS: 5303-5325 |
| FGFR2 | Fibroblast growth factor receptor 2 | SEQ ID NOS: 5326-5347 |
| FGFR3 | Fibroblast growth factor receptor 3 | SEQ ID NOS: 5348-5355 |
| FGFR4 | Fibroblast growth factor receptor 4 | SEQ ID NOS: 5356-5365 |
| FGFRL1 | Fibroblast growth factor receptor-like 1 | SEQ ID NOS: 5366-5371 |
| FGG | Fibrinogen gamma chain | SEQ ID NOS: 5372-5377 |
| FGL1 | Fibrinogen-like 1 | SEQ ID NOS: 5378-5384 |
| FGL2 | Fibrinogen-like 2 | SEQ ID NOS: 5385-5386 |
| FHL1 | Four and a half LIM domains 1 | SEQ ID NOS: 5387-5414 |
| FHOD3 | Formin homology 2 domain containing 3 | SEQ ID NOS: 5415-5421 |
| FIBIN | Fin bud initiation factor homolog (zebrafish) | SEQ ID NO: 5422 |
| FICD | FIC domain containing | SEQ ID NOS: 5423-5426 |
| FJX1 | Four jointed box 1 | SEQ ID NO: 5427 |
| FKBP10 | FK506 binding protein 10, 65 kDa | SEQ ID NOS: 5428-5433 |
| FKBP11 | FK506 binding protein 11, 19 kDa | SEQ ID NOS: 5434-5440 |
| FKBP14 | FK506 binding protein 14, 22 kDa | SEQ ID NOS: 5441-5443 |
| FKBP2 | FK506 binding protein 2, 13 kDa | SEQ ID NOS: 5444-5447 |
| FKBP7 | FK506 binding protein 7 | SEQ ID NOS: 5448-5453 |
| FKBP9 | FK506 binding protein 9, 63 kDa | SEQ ID NOS: 5454-5457 |
| FLT1 | Fms-related tyrosine kinase 1 | SEQ ID NOS: 5458-5466 |
| FLT4 | Fms-related tyrosine kinase 4 | SEQ ID NOS: 5467-5471 |
| FMO1 | Flavin containing monooxygenase 1 | SEQ ID NOS: 5472-5476 |
| FMO2 | Flavin containing monooxygenase 2 (non-functional) | SEQ ID NOS: 5477-5479 |
| FMO3 | Flavin containing monooxygenase 3 | SEQ ID NOS: 5480-5482 |
| FMO5 | Flavin containing monooxygenase 5 | SEQ ID NOS: 5483-5489 |
| FMOD | Fibromodulin | SEQ ID NO: 5490 |
| FN1 | Fibronectin 1 | SEQ ID NOS: 5491-5503 |
| FNDC1 | Fibronectin type III domain containing 1 | SEQ ID NOS: 5504-5505 |
| FNDC7 | Fibronectin type III domain containing 7 | SEQ ID NOS: 5506-5507 |
| FOCAD | Focadhesin | SEQ ID NOS: 5508-5514 |
| FOLR2 | Folate receptor 2 (fetal) | SEQ ID NOS: 5515-5524 |
| FOLR3 | Folate receptor 3 (gamma) | SEQ ID NOS: 5525-5529 |
| FOXRED2 | FAD-dependent oxidoreductase domain containing 2 | SEQ ID NOS: 5530-5533 |
| FP325331.1 | Uncharacterized protein UNQ6126/PRO20091 | SEQ ID NO: 5534 |
| CH507-9B2.3 | | SEQ ID NOS: 5535-5541 |
| FPGS | Folylpolyglutamate synthase | SEQ ID NOS: 5542-5548 |
| FRAS1 | Fraser extracellular matrix complex subunit 1 | SEQ ID NOS: 5549-5554 |
| FREM1 | FRAS1 related extracellular matrix 1 | SEQ ID NOS: 5555-5559 |
| FREM3 | FRAS1 related extracellular matrix 3 | SEQ ID NO: 5560 |
| FRMPD2 | FERM and PDZ domain containing 2 | SEQ ID NOS: 5561-5564 |
| FRZB | Frizzled-related protein | SEQ ID NO: 5565 |
| FSHB | Follicle stimulating hormone, beta polypeptide | SEQ ID NOS: 5566-5568 |
| FSHR | Follicle stimulating hormone receptor | SEQ ID NOS: 5569-5572 |
| FST | Follistatin | SEQ ID NOS: 5573-5576 |
| FSTL1 | Follistatin-like 1 | SEQ ID NOS: 5577-5580 |
| FSTL3 | Follistatin-like 3 (secreted glycoprotein) | SEQ ID NOS: 5581-5586 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| FSTL4 | Follistatin-like 4 | SEQ ID NOS: 5587-5589 |
| FSTL5 | Follistatin-like 5 | SEQ ID NOS: 5590-5592 |
| FTCDNL1 | Formiminotransferase cyclodeaminase N-terminal like | SEQ ID NOS: 5593-5596 |
| FUCA1 | Fucosidase, alpha-L-1, tissue | SEQ ID NO: 5597 |
| FUCA2 | Fucosidase, alpha-L-2, plasma | SEQ ID NOS: 5598-5599 |
| FURIN | Furin (paired basic amino acid cleaving enzyme) | SEQ ID NOS: 5600-5606 |
| FUT10 | Fucosyltransferase 10 (alpha (1,3) fucosyltransferase) | SEQ ID NOS: 5607-5609 |
| FUT11 | Fucosyltransferase 11 (alpha (1,3) fucosyltransferase) | SEQ ID NOS: 5610-5611 |
| FXN | Frataxin | SEQ ID NOS: 5612-5619 |
| FXR1 | Fragile X mental retardation, autosomal homolog 1 | SEQ ID NOS: 5620-5632 |
| FXYD3 | FXYD domain containing ion transport regulator 3 | SEQ ID NOS: 5633-5645 |
| GABBR1 | Gamma-aminobutyric acid (GABA) B receptor, 1 | SEQ ID NOS: 5646-5657 |
| GABRA1 | Gamma-aminobutyric acid (GABA) A receptor, alpha 1 | SEQ ID NOS: 5658-5673 |
| GABRA2 | Gamma-aminobutyric acid (GABA) A receptor, alpha 2 | SEQ ID NOS: 5674-5688 |
| GABRA5 | Gamma-aminobutyric acid (GABA) A receptor, alpha 5 | SEQ ID NOS: 5689-5697 |
| GABRG3 | Gamma-aminobutyric acid (GABA) A receptor, gamma 3 | SEQ ID NOS: 5698-5703 |
| GABRP | Gamma-aminobutyric acid (GABA) A receptor, pi | SEQ ID NOS: 5704-5712 |
| GAL | Galanin/GMAP prepropeptide | SEQ ID NO: 5713 |
| GAL3ST1 | Galactose-3-O-sulfotransferase 1 | SEQ ID NOS: 5714-5735 |
| GAL3ST2 | Galactose-3-O-sulfotransferase 2 | SEQ ID NO: 5736 |
| GAL3ST3 | Galactose-3-O-sulfotransferase 3 | SEQ ID NOS: 5737-5738 |
| GALC | Galactosylceramidase | SEQ ID NOS: 5739-5748 |
| GALNS | Galactosamine (N-acetyl)-6-sulfatase | SEQ ID NOS: 5749-5754 |
| GALNT10 | Polypeptide N-acetylgalactosaminyltransferase 10 | SEQ ID NOS: 5755-5758 |
| GALNT12 | Polypeptide N-acetylgalactosaminyltransferase 12 | SEQ ID NOS: 5759-5760 |
| GALNT15 | Polypeptide N-acetylgalactosaminyltransferase 15 | SEQ ID NOS: 5761-5764 |
| GALNT2 | Polypeptide N-acetylgalactosaminyltransferase 2 | SEQ ID NO: 5765 |
| GALNT6 | Polypeptide N-acetylgalactosaminyltransferase 6 | SEQ ID NOS: 5766-5777 |
| GALNT8 | Polypeptide N-acetylgalactosaminyltransferase 8 | SEQ ID NOS: 5778-5781 |
| GALNTL6 | Polypeptide N-acetylgalactosaminyltransferase-like 6 | SEQ ID NOS: 5782-5785 |
| GALP | Galanin-like peptide | SEQ ID NOS: 5786-5788 |
| GANAB | Glucosidase, alpha; neutral AB | SEQ ID NOS: 5789-5797 |
| GARS | Glycyl-tRNA synthetase | SEQ ID NOS: 5798-5801 |
| GAS1 | Growth arrest-specific 1 | SEQ ID NO: 5802 |
| GAS6 | Growth arrest-specific 6 | SEQ ID NO: 5803 |
| GAST | Gastrin | SEQ ID NO: 5804 |
| PDDC1 | Parkinson disease 7 domain containing 1 | SEQ ID NOS: 5805-5813 |
| GBA | Glucosidase, beta, acid | SEQ ID NOS: 5814-5817 |
| GBGT1 | Globoside alpha-1,3-N-acetylgalactosaminyltransferase 1 | SEQ ID NOS: 5818-5826 |
| GC | Group-specific component (vitamin D binding protein) | SEQ ID NOS: 5827-5831 |
| GCG | Glucagon | SEQ ID NOS: 5832-5833 |
| GCGR | Glucagon receptor | SEQ ID NOS: 5834-5836 |
| GCNT7 | Glucosaminyl (N-acetyl) transferase family member 7 | SEQ ID NOS: 5837-5838 |
| GCSH | Glycine cleavage system protein H (aminomethyl carrier) | SEQ ID NOS: 5839-5847 |
| GDF1 | Growth differentiation factor 1 | SEQ ID NO: 5848 |
| GDF10 | Growth differentiation factor 10 | SEQ ID NO: 5849 |
| GDF11 | Growth differentiation factor 11 | SEQ ID NOS: 5850-5851 |
| GDF15 | Growth differentiation factor 15 | SEQ ID NOS: 5852-5854 |
| GDF2 | Growth differentiation factor 2 | SEQ ID NO: 5855 |
| GDF3 | Growth differentiation factor 3 | SEQ ID NO: 5856 |
| GDF5 | Growth differentiation factor 5 | SEQ ID NOS: 5857-5858 |
| GDF6 | Growth differentiation factor 6 | SEQ ID NOS: 5859-5861 |
| GDF7 | Growth differentiation factor 7 | SEQ ID NO: 5862 |
| GDF9 | Growth differentiation factor 9 | SEQ ID NOS: 5863-5867 |
| GDNF | Glial cell derived neurotrophic factor | SEQ ID NOS: 5868-5875 |
| GFOD2 | Glucose-fructose oxidoreductase domain containing 2 | SEQ ID NOS: 5876-5881 |
| GFPT2 | Glutamine-fructose-6-phosphate transaminase 2 | SEQ ID NOS: 5882-5884 |
| GFRA2 | GDNF family receptor alpha 2 | SEQ ID NOS: 5885-5891 |
| GFRA4 | GDNF family receptor alpha 4 | SEQ ID NOS: 5892-5894 |
| GGA2 | Golgi-associated, gamma adaptin ear containing, ARF binding protein 2 | SEQ ID NOS: 5895-5903 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| GGH | Gamma-glutamyl hydrolase (conjugase, folylpolygammaglutamyl hydrolase) | SEQ ID NO: 5904 |
| GGT1 | Gamma-glutamyltransferase 1 | SEQ ID NOS: 5905-5927 |
| GGT5 | Gamma-glutamyltransferase 5 | SEQ ID NOS: 5928-5932 |
| GH1 | Growth hormone 1 | SEQ ID NOS: 5933-5937 |
| GH2 | Growth hormone 2 | SEQ ID NOS: 5938-5942 |
| GHDC | GH3 domain containing | SEQ ID NOS: 5943-5950 |
| GHRH | Growth hormone releasing hormone | SEQ ID NOS: 5951-5953 |
| GHRHR | Growth hormone releasing hormone receptor | SEQ ID NOS: 5954-5959 |
| GHRL | Ghrelin/obestatin prepropeptide | SEQ ID NOS: 5960-5970 |
| GIF | Gastric intrinsic factor (vitamin B synthesis) | SEQ ID NOS: 5971-5972 |
| GIP | Gastric inhibitory polypeptide | SEQ ID NO: 5973 |
| GKN1 | Gastrokine 1 | SEQ ID NO: 5974 |
| GKN2 | Gastrokine 2 | SEQ ID NOS: 5975-5976 |
| GLA | Galactosidase, alpha | SEQ ID NOS: 5977-5978 |
| GLB1 | Galactosidase, beta 1 | SEQ ID NOS: 5979-5987 |
| GLB1L | Galactosidase, beta 1-like | SEQ ID NOS: 5988-5995 |
| GLB1L2 | Galactosidase, beta 1-like 2 | SEQ ID NOS: 5996-5997 |
| GLCE | Glucuronic acid epimerase | SEQ ID NOS: 5998-5999 |
| GLG1 | Golgi glycoprotein 1 | SEQ ID NOS: 6000-6007 |
| GLIPR1 | GLI pathogenesis-related 1 | SEQ ID NOS: 6008-6011 |
| GLIPR1L1 | GLI pathogenesis-related 1 like 1 | SEQ ID NOS: 6012-6015 |
| GLIS3 | GLIS family zinc finger 3 | SEQ ID NOS: 6016-6024 |
| GLMP | Glycosylated lysosomal membrane protein | SEQ ID NOS: 6025-6033 |
| GLRB | Glycine receptor, beta | SEQ ID NOS: 6034-6039 |
| GLS | Glutaminase | SEQ ID NOS: 6040-6047 |
| GLT6D1 | Glycosyltransferase 6 domain containing 1 | SEQ ID NOS: 6048-6049 |
| GLTPD2 | Glycolipid transfer protein domain containing 2 | SEQ ID NO: 6050 |
| GLUD1 | Glutamate dehydrogenase 1 | SEQ ID NO: 6051 |
| GM2A | GM2 ganglioside activator | SEQ ID NOS: 6052-6054 |
| GML | Glycosylphosphatidylinositol anchored molecule like | SEQ ID NOS: 6055-6056 |
| GNAS | GNAS complex locus | SEQ ID NOS: 6057-6078 |
| GNLY | Granulysin | SEQ ID NOS: 6079-6082 |
| GNPTG | N-acetylglucosamine-1-phosphate transferase, gamma subunit | SEQ ID NOS: 6083-6087 |
| GNRH1 | Gonadotropin-releasing hormone 1 (luteinizing-releasing hormone) | SEQ ID NOS: 6088-6089 |
| GNRH2 | Gonadotropin-releasing hormone 2 | SEQ ID NOS: 6090-6093 |
| GNS | Glucosamine (N-acetyl)-6-sulfatase | SEQ ID NOS: 6094-6099 |
| GOLM1 | Golgi membrane protein 1 | SEQ ID NOS: 6100-6104 |
| GORAB | Golgin, RAB6-interacting | SEQ ID NOS: 6105-6107 |
| GOT2 | Glutamic-oxaloacetic transaminase 2, mitochondrial | SEQ ID NOS: 6108-6110 |
| GP2 | Glycoprotein 2 (zymogen granule membrane) | SEQ ID NOS: 6111-6119 |
| GP6 | Glycoprotein VI (platelet) | SEQ ID NOS: 6120-6123 |
| GPC2 | Glypican 2 | SEQ ID NOS: 6124-6125 |
| GPC5 | Glypican 5 | SEQ ID NOS: 6126-6128 |
| GPC6 | Glypican 6 | SEQ ID NOS: 6129-6130 |
| GPD2 | Glycerol-3-phosphate dehydrogenase 2 (mitochondrial) | SEQ ID NOS: 6131-6139 |
| GPER1 | G protein-coupled estrogen receptor 1 | SEQ ID NOS: 6140-6146 |
| GPHA2 | Glycoprotein hormone alpha 2 | SEQ ID NOS: 6147-6149 |
| GPHB5 | Glycoprotein hormone beta 5 | SEQ ID NOS: 6150-6151 |
| GPIHBP1 | Glycosylphosphatidylinositol anchored high density lipoprotein binding protein 1 | SEQ ID NO: 6152 |
| GPLD1 | Glycosylphosphatidylinositol specific phospholipase D1 | SEQ ID NO: 6153 |
| GPNMB | Glycoprotein (transmembrane) nmb | SEQ ID NOS: 6154-6156 |
| GPR162 | G protein-coupled receptor 162 | SEQ ID NOS: 6157-6160 |
| GPX3 | Glutathione peroxidase 3 | SEQ ID NOS: 6161-6168 |
| GPX4 | Glutathione peroxidase 4 | SEQ ID NOS: 6169-6179 |
| GPX5 | Glutathione peroxidase 5 | SEQ ID NOS: 6180-6181 |
| GPX6 | Glutathione peroxidase 6 | SEQ ID NOS: 6182-6184 |
| GPX7 | Glutathione peroxidase 7 | SEQ ID NO: 6185 |
| GREM1 | Gremlin 1, DAN family BMP antagonist | SEQ ID NOS: 6186-6188 |
| GREM2 | Gremlin 2, DAN family BMP antagonist | SEQ ID NO: 6189 |
| GRHL3 | Grainyhead-like transcription factor 3 | SEQ ID NOS: 6190-6195 |
| GRIA2 | Glutamate receptor, ionotropic, AMPA 2 | SEQ ID NOS: 6196-6207 |
| GRIA3 | Glutamate receptor, ionotropic, AMPA 3 | SEQ ID NOS: 6208-6213 |
| GRIA4 | Glutamate receptor, ionotropic, AMPA 4 | SEQ ID NOS: 6214-6225 |
| GRIK2 | Glutamate receptor, ionotropic, kainate 2 | SEQ ID NOS: 6226-6234 |
| GRIN2B | Glutamate receptor, ionotropic, N-methyl D-aspartate 2B | SEQ ID NOS: 6235-6238 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| GRM2 | Glutamate receptor, metabotropic 2 | SEQ ID NOS: 6239-6242 |
| GRM3 | Glutamate receptor, metabotropic 3 | SEQ ID NOS: 6243-6247 |
| GRM5 | Glutamate receptor, metabotropic 5 | SEQ ID NOS: 6248-6252 |
| GRN | Granulin | SEQ ID NOS: 6253-6268 |
| GRP | Gastrin-releasing peptide | SEQ ID NOS: 6269-6273 |
| DFNA5 | Deafness, autosomal dominant 5 | SEQ ID NOS: 6274-6282 |
| GSG1 | Germ cell associated 1 | SEQ ID NOS: 6283-6291 |
| GSN | Gelsolin | SEQ ID NOS: 6292-6300 |
| GTDC1 | Glycosyltransferase-like domain containing 1 | SEQ ID NOS: 6301-6314 |
| GTPBP10 | GTP-binding protein 10 (putative) | SEQ ID NOS: 6315-6323 |
| GUCA2A | Guanylate cyclase activator 2A (guanylin) | SEQ ID NO: 6324 |
| GUCA2B | Guanylate cyclase activator 2B (uroguanylin) | SEQ ID NO: 6325 |
| GUSB | Glucuronidase, beta | SEQ ID NOS: 6326-6330 |
| GVQW1 | GVQW motif containing 1 | SEQ ID NO: 6331 |
| GXYLT1 | Glucoside xylosyltransferase 1 | SEQ ID NOS: 6332-6333 |
| GXYLT2 | Glucoside xylosyltransferase 2 | SEQ ID NOS: 6334-6336 |
| GYPB | Glycophorin B (MNS blood group) | SEQ ID NOS: 6337-6345 |
| GZMA | Granzyme A (granzyme 1, cytotoxic T-lymphocyte-associated serine esterase 3) | SEQ ID NO: 6346 |
| GZMB | Granzyme B (granzyme 2, cytotoxic T-lymphocyte-associated serine esterase 1) | SEQ ID NOS: 6347-6355 |
| GZMH | Granzyme H (cathepsin G-like 2, protein h-CCPX) | SEQ ID NOS: 6356-6358 |
| GZMK | Granzyme K (granzyme 3; tryptase II) | SEQ ID NO: 6359 |
| GZMM | Granzyme M (lymphocyte met-ase 1) | SEQ ID NOS: 6360-6361 |
| H6PD | Hexose-6-phosphate dehydrogenase (glucose 1-dehydrogenase) | SEQ ID NOS: 6362-6363 |
| HABP2 | Hyaluronan binding protein 2 | SEQ ID NOS: 6364-6365 |
| HADHB | Hydroxyacyl-CoA dehydrogenase/3-ketoacyl-CoA thiolase/enoyl-CoA hydratase (trifunctional protein), beta subunit | SEQ ID NOS: 6366-6372 |
| HAMP | Hepcidin antimicrobial peptide | SEQ ID NOS: 6373-6374 |
| HAPLN1 | Hyaluronan and proteoglycan link protein 1 | SEQ ID NOS: 6375-6381 |
| HAPLN2 | Hyaluronan and proteoglycan link protein 2 | SEQ ID NOS: 6382-6383 |
| HAPLN3 | Hyaluronan and proteoglycan link protein 3 | SEQ ID NOS: 6384-6387 |
| HAPLN4 | Hyaluronan and proteoglycan link protein 4 | SEQ ID NO: 6388 |
| HARS2 | Histidyl-tRNA synthetase 2, mitochondrial | SEQ ID NOS: 6389-6404 |
| HAVCR1 | Hepatitis A virus cellular receptor 1 | SEQ ID NOS: 6405-6409 |
| HCCS | Holocytochrome c synthase | SEQ ID NOS: 6410-6412 |
| HCRT | Hypocretin (orexin) neuropeptide precursor | SEQ ID NO: 6413 |
| CECR5 | Cat eye syndrome chromosome region, candidate 5 | SEQ ID NOS: 6414-6416 |
| HEATR5A | HEAT repeat containing 5A | SEQ ID NOS: 6417-6423 |
| HEPH | Hephaestin | SEQ ID NOS: 6424-6431 |
| HEXA | Hexosaminidase A (alpha polypeptide) | SEQ ID NOS: 6432-6441 |
| HEXB | Hexosaminidase B (beta polypeptide) | SEQ ID NOS: 6442-6447 |
| HFE2 | Hemochromatosis type 2 (juvenile) | SEQ ID NOS: 6448-6454 |
| HGF | Hepatocyte growth factor (hepapoietin A; scatter factor) | SEQ ID NOS: 6455-6465 |
| HGFAC | HGF activator | SEQ ID NOS: 6466-6467 |
| HHIP | Hedgehog interacting protein | SEQ ID NOS: 6468-6469 |
| HHIPL1 | HHIP-like 1 | SEQ ID NOS: 6470-6471 |
| HHIPL2 | HHIP-like 2 | SEQ ID NO: 6472 |
| HHLA1 | HERV-H LTR-associating 1 | SEQ ID NOS: 6473-6474 |
| HHLA2 | HERV-H LTR-associating 2 | SEQ ID NOS: 6475-6485 |
| HIBADH | 3-hydroxyisobutyrate dehydrogenase | SEQ ID NOS: 6486-6488 |
| HINT2 | Histidine triad nucleotide binding protein 2 | SEQ ID NO: 6489 |
| HLA-A | Major histocompatibility complex, class I, A | SEQ ID NOS: 6490-6494 |
| HLA-C | Major histocompatibility complex, class I, C | SEQ ID NOS: 6495-6499 |
| HLA-DOA | Major histocompatibility complex, class II, DO alpha | SEQ ID NOS: 6500-6501 |
| HLA-DPA1 | Major histocompatibility complex, class II, DP alpha 1 | SEQ ID NOS: 6502-6505 |
| HLA-DQA1 | Major histocompatibility complex, class II, DQ alpha 1 | SEQ ID NOS: 6506-6511 |
| HLA-DQB1 | Major histocompatibility complex, class II, DQ beta 1 | SEQ ID NOS: 6512-6517 |
| HLA-DQB2 | Major histocompatibility complex, class II, DQ beta 2 | SEQ ID NOS: 6518-6521 |
| HMCN1 | Hemicentin 1 | SEQ ID NOS: 6522-6523 |
| HMCN2 | Hemicentin 2 | SEQ ID NOS: 6524-6527 |
| HMGCL | 3-hydroxymethyl-3-methylglutaryl-CoA lyase | SEQ ID NOS: 6528-6531 |
| HMSD | Histocompatibility (minor) serpin domain containing | SEQ ID NOS: 6532-6533 |
| HP | Haptoglobin | SEQ ID NOS: 6534-6547 |
| HPR | Haptoglobin-related protein | SEQ ID NOS: 6548-6550 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| HPSE | Heparanase | SEQ ID NOS: 6551-6557 |
| HPSE2 | Heparanase 2 (inactive) | SEQ ID NOS: 6558-6563 |
| HPX | Hemopexin | SEQ ID NOS: 6564-6565 |
| HRC | Histidine rich calcium binding protein | SEQ ID NOS: 6566-6568 |
| HRG | Histidine-rich glycoprotein | SEQ ID NO: 6569 |
| HS2ST1 | Heparan sulfate 2-O-sulfotransferase 1 | SEQ ID NOS: 6570-6572 |
| HS3ST1 | Heparan sulfate (glucosamine) 3-O-sulfotransferase 1 | SEQ ID NOS: 6573-6575 |
| HS6ST1 | Heparan sulfate 6-O-sulfotransferase 1 | SEQ ID NO: 6576 |
| HS6ST3 | Heparan sulfate 6-O-sulfotransferase 3 | SEQ ID NOS: 6577-6578 |
| HSD11B1L | Hydroxysteroid (11-beta) dehydrogenase 1-like | SEQ ID NOS: 6579-6597 |
| HSD17B11 | Hydroxysteroid (17-beta) dehydrogenase 11 | SEQ ID NOS: 6598-6599 |
| HSD17B7 | Hydroxysteroid (17-beta) dehydrogenase 7 | SEQ ID NOS: 6600-6604 |
| HSP90B1 | Heat shock protein 90 kDa beta (Grp94), member 1 | SEQ ID NOS: 6605-6610 |
| HSPA13 | Heat shock protein 70 kDa family, member 13 | SEQ ID NO: 6611 |
| HSPA5 | Heat shock 70 kDa protein 5 (glucose-regulated protein, 78 kDa) | SEQ ID NO: 6612 |
| HSPG2 | Heparan sulfate proteoglycan 2 | SEQ ID NOS: 6613-6617 |
| HTATIP2 | HIV-1 Tat interactive protein 2, 30 kDa | SEQ ID NOS: 6618-6625 |
| HTN1 | Histatin 1 | SEQ ID NOS: 6626-6628 |
| HTN3 | Histatin 3 | SEQ ID NOS: 6629-6631 |
| HTRA1 | HtrA serine peptidase 1 | SEQ ID NOS: 6632-6633 |
| HTRA3 | HtrA serine peptidase 3 | SEQ ID NOS: 6634-6635 |
| HTRA4 | HtrA serine peptidase 4 | SEQ ID NO: 6636 |
| HYAL1 | Hyaluronoglucosaminidase 1 | SEQ ID NOS: 6637-6645 |
| HYAL2 | Hyaluronoglucosaminidase 2 | SEQ ID NOS: 6646-6654 |
| HYAL3 | Hyaluronoglucosaminidase 3 | SEQ ID NOS: 6655-6661 |
| HYOU1 | Hypoxia up-regulated 1 | SEQ ID NOS: 6662-6676 |
| IAPP | Islet amyloid polypeptide | SEQ ID NOS: 6677-6681 |
| IBSP | Integrin-binding sialoprotein | SEQ ID NO: 6682 |
| ICAM1 | Intercellular adhesion molecule 1 | SEQ ID NOS: 6683-6685 |
| ICAM2 | Intercellular adhesion molecule 2 | SEQ ID NOS: 6686-6696 |
| ICAM4 | Intercellular adhesion molecule 4 (Landsteiner-Wiener blood group) | SEQ ID NOS: 6697-6699 |
| ID1 | Inhibitor of DNA binding 1, dominant negative helix-loop-helix protein | SEQ ID NOS: 6700-6701 |
| IDE | Insulin-degrading enzyme | SEQ ID NOS: 6702-6705 |
| IDNK | IdnK, gluconokinase homolog (E. coli) | SEQ ID NOS: 6706-6711 |
| IDS | Iduronate 2-sulfatase | SEQ ID NOS: 6712-6717 |
| IDUA | Iduronidase, alpha-L- | SEQ ID NOS: 6718-6723 |
| IFI27L2 | Interferon, alpha-inducible protein 27-like 2 | SEQ ID NOS: 6724-6725 |
| IFI30 | Interferon, gamma-inducible protein 30 | SEQ ID NOS: 6726-6727 |
| IFNA1 | Interferon, alpha 1 | SEQ ID NO: 6728 |
| IFNA10 | Interferon, alpha 10 | SEQ ID NO: 6729 |
| IFNA13 | Interferon, alpha 13 | SEQ ID NOS: 6730-6731 |
| IFNA14 | Interferon, alpha 14 | SEQ ID NO: 6732 |
| IFNA16 | Interferon, alpha 16 | SEQ ID NO: 6733 |
| IFNA17 | Interferon, alpha 17 | SEQ ID NO: 6734 |
| IFNA2 | Interferon, alpha 2 | SEQ ID NO: 6735 |
| IFNA21 | Interferon, alpha 21 | SEQ ID NO: 6736 |
| IFNA4 | Interferon, alpha 4 | SEQ ID NO: 6737 |
| IFNA5 | Interferon, alpha 5 | SEQ ID NO: 6738 |
| IFNA6 | Interferon, alpha 6 | SEQ ID NOS: 6739-6740 |
| IFNA7 | Interferon, alpha 7 | SEQ ID NO: 6741 |
| IFNA8 | Interferon, alpha 8 | SEQ ID NO: 6742 |
| IFNAR1 | Interferon (alpha, beta and omega) receptor 1 | SEQ ID NOS: 6743-6744 |
| IFNB1 | Interferon, beta 1, fibroblast | SEQ ID NO: 6745 |
| IFNE | Interferon, epsilon | SEQ ID NO: 6746 |
| IFXG | Interferon, gamma | SEQ ID NO: 6747 |
| IFNGR1 | Interferon gamma receptor 1 | SEQ ID NOS: 6748-6758 |
| IFNL1 | Interferon, lambda 1 | SEQ ID NO: 6759 |
| IFNL2 | Interferon, lambda 2 | SEQ ID NO: 6760 |
| IFNL3 | Interferon, lambda 3 | SEQ ID NOS: 6761-6762 |
| IFNLR1 | Interferon, lambda receptor 1 | SEQ ID NOS: 6763-6767 |
| IFNW1 | Interferon, omega 1 | SEQ ID NO: 6768 |
| IGF1 | Insulin-like growth factor I (somatomedin C) | SEQ ID NOS: 6769-6774 |
| IGF2 | Insulin-like growth factor 2 | SEQ ID NOS: 6775-6782 |
| IGFALS | Insulin-like growth factor binding protein, acid labile subunit | SEQ ID NOS: 6783-6785 |
| IGFBP1 | Insulin-like growth factor binding protein 1 | SEQ ID NOS: 6786-6788 |
| IGFBP2 | Insulin-like growth factor binding protein 2, 36 kDa | SEQ ID NOS: 6789-6792 |
| IGFBP3 | Insulin-like growth factor binding protein 3 | SEQ ID NOS: 6793-6800 |
| IGFBP4 | Insulin-like growth factor binding protein 4 | SEQ ID NO: 6801 |
| IGFBP5 | Insulin-like growth factor binding protein 5 | SEQ ID NOS: 6802-6803 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| IGFBP6 | Insulin-like growth factor binding protein 6 | SEQ ID NOS: 6804-6806 |
| IGFBP7 | Insulin-like growth factor binding protein 7 | SEQ ID NOS: 6807-6808 |
| IGFBPL1 | Insulin-like growth factor binding protein-like 1 | SEQ ID NO: 6809 |
| IGFL1 | IGF-like family member 1 | SEQ ID NO: 6810 |
| IGFL2 | IGF-like family member 2 | SEQ ID NOS: 6811-6813 |
| IGFL3 | IGF-like family member 3 | SEQ ID NO: 6814 |
| IGFLR1 | IGF-like family receptor 1 | SEQ ID NOS: 6815-6823 |
| IGIP | IgA-inducing protein | SEQ ID NO: 6824 |
| IGLON5 | IgLON family member 5 | SEQ ID NO: 6825 |
| IGSF1 | Immunoglobulin superfamily, member 1 | SEQ ID NOS: 6826-6831 |
| IGSF10 | Immunoglobulin superfamily, member 10 | SEQ ID NOS: 6832-6833 |
| IGSF11 | Immunoglobulin superfamily, member 11 | SEQ ID NOS: 6834-6841 |
| IGSF21 | Immunoglobulin superfamily, member 21 | SEQ ID NO: 6842 |
| IGSF8 | Immunoglobulin superfamily, member 8 | SEQ ID NOS: 6843-6846 |
| IGSF9 | Immunoglobulin superfamily, member 9 | SEQ ID NOS: 6847-6849 |
| IHH | Indian hedgehog | SEQ ID NO: 6850 |
| IL10 | Interleukin 10 | SEQ ID NOS: 6851-6852 |
| IL11 | Interleukin 11 | SEQ ID NOS: 6853-6856 |
| IL11RA | Interleukin 11 receptor, alpha | SEQ ID NOS: 6857-6867 |
| IL12B | Interleukin 12B | SEQ ID NO: 6868 |
| IL12RB1 | Interleukin 12 receptor, beta 1 | SEQ ID NOS: 6869-6874 |
| IL12RB2 | Interleukin 12 receptor, beta 2 | SEQ ID NOS: 6875-6879 |
| IL13 | Interleukin 13 | SEQ ID NOS: 6880-6881 |
| IL13RA1 | Interleukin 13 receptor, alpha 1 | SEQ ID NOS: 6882-6883 |
| IL15RA | Interleukin 15 receptor, alpha | SEQ ID NOS: 6884-6901 |
| IL17A | Interleukin 17A | SEQ ID NO: 6902 |
| IL17B | Interleukin 17B | SEQ ID NO: 6903 |
| IL17C | Interleukin 17C | SEQ ID NO: 6904 |
| IL17D | Interleukin 17D | SEQ ID NOS: 6905-6907 |
| IL17F | Interleukin 17F | SEQ ID NO: 6908 |
| IL17RA | Interleukin 17 receptor A | SEQ ID NOS: 6909-6910 |
| IL17RC | Interleukin 17 receptor C | SEQ ID NOS: 6911-6926 |
| IL17RE | Interleukin 17 receptor E | SEQ ID NOS: 6927-6933 |
| 1L18BP | Interleukin 18 binding protein | SEQ ID NOS: 6934-6944 |
| IL18R1 | Interleukin 18 receptor 1 | SEQ ID NOS: 6945-6948 |
| IL18RAP | Interleukin 18 receptor accessory protein | SEQ ID NOS: 6949-6951 |
| IL19 | Interleukin 19 | SEQ ID NOS: 6952-6954 |
| IL1R1 | Interleukin 1 receptor, type I | SEQ ID NOS: 6955-6967 |
| IL1R2 | Interleukin 1 receptor, type II | SEQ ID NOS: 6968-6971 |
| IL1RAP | Interleukin 1 receptor accessory protein | SEQ ID NOS: 6972-6985 |
| IL1RL1 | Interleukin 1 receptor-like 1 | SEQ ID NOS: 6986-6991 |
| IL1RL2 | Interleukin 1 receptor-like 2 | SEQ ID NOS: 6992-6994 |
| IL1RN | Interleukin 1 receptor antagonist | SEQ ID NOS: 6995-6999 |
| IL2 | Interleukin 2 | SEQ ID NO: 7000 |
| IL20 | Interleukin 20 | SEQ ID NOS: 7001-7003 |
| IL20RA | Interleukin 20 receptor, alpha | SEQ ID NOS: 7004-7010 |
| IL21 | Interleukin 21 | SEQ ID NOS: 7011-7012 |
| IL22 | Interleukin 22 | SEQ ID NOS: 7013-7014 |
| IL22RA2 | Interleukin 22 receptor, alpha 2 | SEQ ID NOS: 7015-7017 |
| IL23A | Interleukin 23, alpha subunit p19 | SEQ ID NO: 7018 |
| IL24 | Interleukin 24 | SEQ ID NOS: 7019-7024 |
| IL25 | Interleukin 25 | SEQ ID NOS: 7025-7026 |
| 1L26 | Interleukin 26 | SEQ ID NO: 7027 |
| IL27 | Interleukin 27 | SEQ ID NOS: 7028-7029 |
| IL2RB | Interleukin 2 receptor, beta | SEQ ID NOS: 7030-7034 |
| IL3 | Interleukin 3 | SEQ ID NO: 7035 |
| IL31 | Interleukin 31 | SEQ ID NO: 7036 |
| IL31RA | Interleukin 31 receptor A | SEQ ID NOS: 7037-7044 |
| IL32 | Interleukin 32 | SEQ ID NOS: 7045-7074 |
| IL34 | Interleukin 34 | SEQ ID NOS: 7075-7078 |
| IL3RA | Interleukin 3 receptor, alpha (low affinity) | SEQ ID NOS: 7079-7081 |
| IL4 | Interleukin 4 | SEQ ID NOS: 7082-7084 |
| IL4I1 | Interleukin 4 induced 1 | SEQ ID NOS: 7085-7092 |
| IL4R | Interleukin 4 receptor | SEQ ID NOS: 7093-7106 |
| IL5 | Interleukin 5 | SEQ ID NOS: 7107-7108 |
| IL5RA | Interleukin 5 receptor, alpha | SEQ ID NOS: 7109-7118 |
| IL6 | Interleukin 6 | SEQ ID NOS: 7119-7125 |
| IL6R | Interleukin 6 receptor | SEQ ID NOS: 7126-7131 |
| IL6ST | Interleukin 6 signal transducer | SEQ ID NOS: 7132-7141 |
| IL7 | Interleukin 7 | SEQ ID NOS: 7142-7149 |
| IL7R | Interleukin 7 receptor | SEQ ID NOS: 7150-7156 |
| IL9 | Interleukin 9 | SEQ ID NO: 7157 |
| ILDR1 | Immunoglobulin-like domain containing receptor 1 | SEQ ID NOS: 7158-7162 |
| ILDR2 | Immunoglobulin-like domain containing receptor 2 | SEQ ID NOS: 7163-7169 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| IMP4 | IMP4, U3 small nucleolar ribonucleoprotein | SEQ ID NOS: 7170-7175 |
| IMPG1 | Interphotoreceptor matrix proteoglycan 1 | SEQ ID NOS: 7176-7179 |
| INHA | Inhibin, alpha | SEQ ID NO: 7180 |
| INHBA | Inhibin, beta A | SEQ ID NOS: 7181-7183 |
| INHBB | Inhibin, beta B | SEQ ID NO: 7184 |
| INHBC | Inhibin, beta C | SEQ ID NO: 7185 |
| INHBE | Inhibin, beta E | SEQ ID NOS: 7186-7187 |
| INPP5A | Inositol polyphosphate-5-phosphatase A | SEQ ID NOS: 7188-7192 |
| INS | Insulin | SEQ ID NOS: 7193-7197 |
| INS-IGF2 | INS-IGF2 readthrough | SEQ ID NOS: 7198-7199 |
| INSL3 | Insulin-like 3 (Leydig cell) | SEQ ID NOS: 7200-7202 |
| INSL4 | Insulin-like 4 (placenta) | SEQ ID NO: 7203 |
| INSL5 | Insulin-like 5 | SEQ ID NO: 7204 |
| INSL6 | Insulin-like 6 | SEQ ID NO: 7205 |
| INTS3 | Integrator complex subunit 3 | SEQ ID NOS: 7206-7211 |
| IPO11 | Importin 11 | SEQ ID NOS: 7212-7220 |
| IPO9 | Importin 9 | SEQ ID NOS: 7221-7222 |
| IQCF6 | IQ motif containing F6 | SEQ ID NOS: 7223-7224 |
| IRAK3 | Interleukin-1 receptor-associated kinase 3 | SEQ ID NOS: 7225-7227 |
| IRS4 | Insulin receptor substrate 4 | SEQ ID NO: 7228 |
| ISLR | Immunoglobulin superfamily containing leucine-rich repeat | SEQ ID NOS: 7229-7232 |
| ISLR2 | Immunoglobulin superfamily containing leucine-rich repeat 2 | SEQ ID NOS: 7233-7242 |
| ISM1 | Isthmin 1, angiogenesis inhibitor | SEQ ID NO: 7243 |
| ISM2 | Isthmin 2 | SEQ ID NOS: 7244-7249 |
| ITGA4 | Integrin, alpha 4 (antigen CD49D, alpha 4 subunit of VLA-4 receptor) | SEQ ID NOS: 7250-7252 |
| ITGA9 | Integrin, alpha 9 | SEQ ID NOS: 7253-7255 |
| ITGAL | Integrity alpha L (antigen CD11A (p180), lymphocyte function-associated antigen 1; alpha polypeptide) | SEQ ID NOS: 7256-7265 |
| ITGAX | Integrin, alpha X (complement component 3 receptor 4 subunit) | SEQ ID NOS: 7266-7268 |
| ITGB1 | Integrin, beta 1 (fibronectin receptor, beta polypeptide, antigen CD29 includes MDF2, MSK12) | SEQ ID NOS: 7269-7284 |
| ITGB2 | Integrin, beta 2 (complement component 3 receptor 3 and 4 subunit) | SEQ ID NOS: 7285-7301 |
| ITGB3 | Integrin, beta 3 (platelet glycoprotein IIIa, antigen CD61) | SEQ ID NOS: 7302-7304 |
| ITGB7 | Integrin, beta 7 | SEQ ID NOS: 7305-7312 |
| ITGBL1 | Integrin, beta-like 1 (with EGF-like repeat domains) | SEQ ID NOS: 7313-7318 |
| ITIH1 | Inter-alpha-trypsin inhibitor heavy chain 1 | SEQ ID NOS: 7319-7324 |
| ITIH2 | Inter-alpha-trypsin inhibitor heavy chain 2 | SEQ ID NOS: 7325-7327 |
| ITIH3 | Inter-alpha-trypsin inhibitor heavy chain 3 | SEQ ID NOS: 7328-7330 |
| ITIH4 | Inter-alpha-trypsin inhibitor heavy chain family, member 4 | SEQ ID NOS: 7331-7334 |
| ITIH5 | Inter-alpha-trypsin inhibitor heavy chain family, member 5 | SEQ ID NOS: 7335-7338 |
| ITIH6 | Inter-alpha-trypsin inhibitor heavy chain family, member 6 | SEQ ID NO: 7339 |
| ITLN1 | Intelectin 1 (galactofuranose binding) | SEQ ID NO: 7340 |
| ITLN2 | Intelectin 2 | SEQ ID NO: 7341 |
| IZUMO1R | IZUMO1 receptor, JUNO | SEQ ID NOS: 7342-7343 |
| IZUMO4 | IZUMO family member 4 | SEQ ID NOS: 7344-7350 |
| AMICA1 | Adhesion molecule, interacts with CXADR antigen 1 | SEQ ID NOS: 7351-7359 |
| JCHAIN | Joining chain of multimeric IgA and IgM | SEQ ID NOS: 7360-7365 |
| JMJD8 | Jumonji domain containing 8 | SEQ ID NOS: 7366-7370 |
| JSRP1 | Junctional sarcoplasmic reticulum protein 1 | SEQ ID NO: 7371 |
| KANSL2 | KAT8 regulatory NSL complex subunit 2 | SEQ ID NOS: 7372-7382 |
| KAZALD1 | Kazal-type serine peptidase inhibitor domain 1 | SEQ ID NO: 7383 |
| KCNIP3 | Kv channel interacting protein 3, calsenilin | SEQ ID NOS: 7384-7386 |
| KCNK7 | Potassium channel, two pore domain subfamily K, member 7 | SEQ ID NOS: 7387-7392 |
| KCNN4 | Potassium channel, calcium activated intermediate/small conductance subfamily N alpha, member 4 | SEQ ID NOS: 7393-7398 |
| KCNU1 | Potassium channel, subfamily U, member 1 | SEQ ID NOS: 7399-7403 |
| KCP | Kielin/chordin-like protein | SEQ ID NOS: 7404-7407 |
| KDELC1 | KDEL (Lys-Asp-Glu-Leu) containing 1 | SEQ ID NO: 7408 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| KDELC2 | KDEL (Lys-Asp-Glu-Leu) containing 2 | SEQ ID NOS: 7409-7412 |
| KDM1A | Lysine (K)-specific demethylase 1A | SEQ ID NOS: 7413-7416 |
| KDM3B | Lysine (K)-specific demethylase 3B | SEQ ID NOS: 7417-7420 |
| KDM6A | Lysine (K)-specific demethylase 6A | SEQ ID NOS: 7421-7430 |
| KDM7A | Lysine (K)-specific demethylase 7A | SEQ ID NOS: 7431-7432 |
| KDSR | 3-ketodihydrosphingosine reductase | SEQ ID NOS: 7433-7439 |
| KERA | Keratocan | SEQ ID NO: 7440 |
| KIAA0100 | KIAA0100 | SEQ ID NOS: 7441-7446 |
| KIAA0319 | KIAA0319 | SEQ ID NOS: 7447-7452 |
| KIAA1324 | KIAA1324 | SEQ ID NOS: 7453-7461 |
| KIFC2 | Kinesin family member C2 | SEQ ID NOS: 7462-7464 |
| KIR2DL4 | Killer cell immunoglobulin-like receptor, two domains, long cytoplasmic tail, 4 | SEQ ID NOS: 7465-7471 |
| KIR3DX1 | Killer cell immunoglobulin-like receptor, three domains, X1 | SEQ ID NOS: 7472-7476 |
| KIRREL2 | Kin of IRRE like 2 (Drosophila) | SEQ ID NOS: 7477-7481 |
| KISS1 | KiSS-1 metastasis-suppressor | SEQ ID NOS: 7482-7483 |
| KLHL11 | Kelch-like family member 11 | SEQ ID NO: 7484 |
| KLHL22 | Kelch-like family member 22 | SEQ ID NOS: 7485-7491 |
| KLK1 | Kallikrein 1 | SEQ ID NOS: 7492-7493 |
| KLK10 | Kallikrein-related peptidase 10 | SEQ ID NOS: 7494-7498 |
| KLK11 | Kallikrein-related peptidase 11 | SEQ ID NOS: 7499-7507 |
| KLK12 | Kallikrein-related peptidase 12 | SEQ ID NOS: 7508-7514 |
| KLK13 | Kallikrein-related peptidase 13 | SEQ ID NOS: 7515-7523 |
| KLK14 | Kallikrein-related peptidase 14 | SEQ ID NOS: 7524-7525 |
| KLK15 | Kallikrein-related peptidase 15 | SEQ ID NOS: 7526-7530 |
| KLK2 | Kallikrein-related peptidase 2 | SEQ ID NOS: 7531-7543 |
| KLK3 | Kallikrein-related peptidase 3 | SEQ ID NOS: 7544-7555 |
| KLK4 | Kallikrein-related peptidase 4 | SEQ ID NOS: 7556-7560 |
| KLK5 | Kallikrein-related peptidase 5 | SEQ ID NOS: 7561-7564 |
| KLK6 | Kallikrein-related peptidase 6 | SEQ ID NOS: 7565-7571 |
| KLK7 | Kallikrein-related peptidase 7 | SEQ ID NOS: 7572-7576 |
| KLK8 | Kallikrein-related peptidase 8 | SEQ ID NOS: 7577-7584 |
| KLK9 | Kallikrein-related peptidase 9 | SEQ ID NOS: 7585-7586 |
| KLKB1 | Kallikrein B, plasma (Fletcher factor) 1 | SEQ ID NOS: 7587-7591 |
| SETD8 | SET domain containing (lysine methyltransferase) 8 | SEQ ID NOS: 7592-7595 |
| KNDC1 | Kinase non-catalytic C-lobe domain (KIND) containing 1 | SEQ ID NOS: 7596-7597 |
| KNG1 | Kininogen 1 | SEQ ID NOS: 7598-7602 |
| KRBA2 | KRAB-A domain containing 2 | SEQ ID NOS: 7603-7606 |
| KREMEN2 | Kringle containing transmembrane protein 2 | SEQ ID NOS: 7607-7612 |
| KRTDAP | Keratinocyte differentiation-associated protein | SEQ ID NOS: 7613-7614 |
| L1CAM | L1 cell adhesion molecule | SEQ ID NOS: 7615-7624 |
| L3MBTL2 | L(3)mbt-like 2 (Drosophila) | SEQ ID NOS: 7625-7629 |
| LACRT | Lacritin | SEQ ID NOS: 7630-7632 |
| LACTB | Lactamase, beta | SEQ ID NOS: 7633-7635 |
| LAG3 | Lymphocyte-activation gene 3 | SEQ ID NOS: 7636-7637 |
| LAIR2 | Leukocyte-associated immunoglobulin-like receptor 2 | SEQ ID NOS: 7638-7641 |
| LALBA | Lactalbumin, alpha- | SEQ ID NOS: 7642-7643 |
| LAMA1 | Laminin, alpha 1 | SEQ ID NOS: 7644-7645 |
| LAMA2 | Laminin, alpha 2 | SEQ ID NOS: 7646-7649 |
| LAMA3 | Laminin, alpha 3 | SEQ ID NOS: 7650-7659 |
| LAMA4 | Laminin, alpha 4 | SEQ ID NOS: 7660-7674 |
| LAMA5 | Laminin, alpha 5 | SEQ ID NOS: 7675-7677 |
| LAMB1 | Laminin, beta 1 | SEQ ID NOS: 7678-7682 |
| LAMB2 | Laminin, beta 2 (laminin S) | SEQ ID NOS: 7683-7685 |
| LAMB3 | Laminin, beta 3 | SEQ ID NOS: 7686-7690 |
| LAMB4 | Laminin, beta 4 | SEQ ID NOS: 7691-7694 |
| LAMC1 | Laminin, gamma 1 (formerly LAMB2) | SEQ ID NOS: 7695-7696 |
| LAMC2 | Laminin, gamma 2 | SEQ ID NOS: 7697-7698 |
| LAMC3 | Laminin, gamma 3 | SEQ ID NOS: 7699-7700 |
| LAMP3 | Lysosomal-associated membrane protein 3 | SEQ ID NOS: 7701-7704 |
| GYLTL1B | Glycosyltransferase-like 1B | SEQ ID NOS: 7705-7710 |
| LAT | Linker for activation of T cells | SEQ ID NOS: 7711-7720 |
| LAT2 | Linker for activation of T cells family, member 2 | SEQ ID NOS: 7721-7729 |
| LBP | Lipopolysaccharide binding protein | SEQ ID NO: 7730 |
| LCAT | Lecithin-cholesterol acyltransferase | SEQ ID NOS: 7731-7737 |
| LCN1 | Lipocalin 1 | SEQ ID NOS: 7738-7739 |
| LCN10 | Lipocalin 10 | SEQ ID NOS: 7740-7745 |
| LCN12 | Lipocalin 12 | SEQ ID NOS: 7746-7748 |
| LCN15 | Lipocalin 15 | SEQ ID NO: 7749 |
| LCN2 | Lipocalin 2 | SEQ ID NOS: 7750-7752 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| LCN6 | Lipocalin 6 | SEQ ID NOS: 7753-7754 |
| LCN8 | Lipocalin 8 | SEQ ID NOS: 7755-7756 |
| LCN9 | Lipocalin 9 | SEQ ID NOS: 7757-7758 |
| LCORL | Ligand dependent nuclear receptor corepressor-like | SEQ ID NOS: 7759-7764 |
| LDLR | Low density lipoprotein receptor | SEQ ID NOS: 7765-7773 |
| LDLRAD2 | Low density lipoprotein receptor class A domain containing 2 | SEQ ID NOS: 7774-7775 |
| LEAP2 | Liver expressed antimicrobial peptide 2 | SEQ ID NO: 7776 |
| LECT2 | Leukocyte cell-derived chemotaxin 2 | SEQ ID NOS: 7777-7780 |
| LEFTY1 | Left-right determination factor 1 | SEQ ID NOS: 7781-7782 |
| LEFTY2 | Left-right determination factor 2 | SEQ ID NOS: 7783-7784 |
| LEP | Leptin | SEQ ID NO: 7785 |
| LFNG | LFNG O-fucosylpeptide 3-beta-N-acetylglucosaminyltransferase | SEQ ID NOS: 7786-7791 |
| LGALS3BP | Lectin, galactoside-binding, soluble, 3 binding protein | SEQ ID NOS: 7792-7806 |
| LGI1 | Leucine-rich, glioma inactivated 1 | SEQ ID NOS: 7807-7825 |
| LGI2 | Leucine-rich repeat LGI family, member 2 | SEQ ID NOS: 7826-7827 |
| LGI3 | Leucine-rich repeat LGI family, member 3 | SEQ ID NOS: 7828-7831 |
| LGI4 | Leucine-rich repeat LGI family, member 4 | SEQ ID NOS: 7832-7835 |
| LGMN | Legumain | SEQ ID NOS: 7836-7849 |
| LGR4 | Leucine-rich repeat containing G protein-coupled receptor 4 | SEQ ID NOS: 7850-7852 |
| LHB | Luteinizing hormone beta polypeptide | SEQ ID NO: 7853 |
| LHCGR | Luteinizing hormone/choriogonadotropin receptor | SEQ ID NOS: 7854-7858 |
| LIF | Leukemia inhibitory factor | SEQ ID NOS: 7859-7860 |
| LIFR | Leukemia inhibitory factor receptor alpha | SEQ ID NOS: 7861-7865 |
| LILRA1 | Leukocyte immunoglobulin-like receptor, subfamily A (with TM domain), member 1 | SEQ ID NOS: 7866-7867 |
| LILRA2 | Leukocyte immunoglobulin-like receptor, subfamily A (with TM domain), member 2 | SEQ ID NOS: 7868-7874 |
| LILRB3 | Leukocyte immunoglobulin-like receptor, subfamily B (with TM and ITIM domains), member 3 | SEQ ID NOS: 7875-7879 |
| LIME1 | Lck interacting transmembrane adaptor 1 | SEQ ID NOS: 7880-7885 |
| LINGO1 | Leucine rich repeat and Ig domain containing 1 | SEQ ID NOS: 7886-7896 |
| LIPA | Lipase A, lysosomal acid, cholesterol esterase | SEQ ID NOS: 7897-7901 |
| LIPC | Lipase, hepatic | SEQ ID NOS: 7902-7905 |
| LIPF | Lipase, gastric | SEQ ID NOS: 7906-7909 |
| LIPG | Lipase, endothelial | SEQ ID NOS: 7910-7915 |
| LIPH | Lipase, member H | SEQ ID NOS: 7916-7920 |
| LIPK | Lipase, family member K | SEQ ID NO: 7921 |
| LIPM | Lipase, family member M | SEQ ID NOS: 7922-7923 |
| LIPN | Lipase, family member N | SEQ ID NO: 7924 |
| LMAN2 | Lectin, mannose-binding 2 | SEQ ID NOS: 7925-7929 |
| LMNTD1 | Lamin tail domain containing 1 | SEQ ID NOS: 7930-7940 |
| LNX1 | Ligand of numb-protein X 1, E3 ubiquitin protein ligase | SEQ ID NOS: 7941-7947 |
| LOX | Lysyl oxidase | SEQ ID NOS: 7948-7950 |
| LOXL1 | Lysyl oxidase-like 1 | SEQ ID NOS: 7951-7952 |
| LOXL2 | Lysyl oxidase-like 2 | SEQ ID NOS: 7953-7961 |
| LOXL3 | Lysyl oxidase-like 3 | SEQ ID NOS: 7962-7968 |
| LOXL4 | Lysyl oxidase-like 4 | SEQ ID NO: 7969 |
| LPA | Lipoprotein, Lp(a) | SEQ ID NOS: 7970-7972 |
| LPL | Lipoprotein lipase | SEQ ID NOS: 7973-7977 |
| LPO | Lactoperoxidase | SEQ ID NOS: 7978-7984 |
| LRAT | Lecithin retinol acyltransferase (phosphatidylcholine--retinol O-acyltransferase) | SEQ ID NOS: 7985-7987 |
| LRCH3 | Leucine-rich repeats and calponin homology (CH) domain containing 3 | SEQ ID NOS: 7988-7996 |
| LRCOL1 | Leucine rich colipase-like 1 | SEQ ID NOS: 7997-8000 |
| LRFN4 | Leucine rich repeat and fibronectin type III domain containing 4 | SEQ ID NOS: 8001-8002 |
| LRFN5 | Leucine rich repeat and fibronectin type III domain containing 5 | SEQ ID NOS: 8003-8005 |
| LRG1 | Leucine-rich alpha-2-glycoprotein 1 | SEQ ID NO: 8006 |
| LRP1 | Low density lipoprotein receptor-related protein 1 | SEQ ID NOS: 8007-8012 |
| LRP11 | Low density lipoprotein receptor-related protein 11 | SEQ ID NOS: 8013-8014 |
| LRP1B | Low density lipoprotein receptor-related protein 1B | SEQ ID NOS: 8015-8018 |
| LRP2 | Low density lipoprotein receptor-related protein 2 | SEQ ID NOS: 8019-8020 |
| LRP4 | Low density lipoprotein receptor-related protein 4 | SEQ ID NOS: 8021-8022 |
| LRPAP1 | Low density lipoprotein receptor-related protein associated protein 1 | SEQ ID NOS: 8023-8024 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| LRRC17 | Leucine rich repeat containing 17 | SEQ ID NOS: 8025-8027 |
| LRRC32 | Leucine rich repeat containing 32 | SEQ ID NOS: 8028-8031 |
| LRRC3B | Leucine rich repeat containing 3B | SEQ ID NOS: 8032-8036 |
| LRRC4B | Leucine rich repeat containing 4B | SEQ ID NOS: 8037-8039 |
| LRRC70 | Leucine rich repeat containing 70 | SEQ ID NOS: 8040-8041 |
| LRRN3 | Leucine rich repeat neuronal 3 | SEQ ID NOS: 8042-8045 |
| LRRTM1 | Leucine rich repeat transmembrane neuronal 1 | SEQ ID NOS: 8046-8052 |
| LRRTM2 | Leucine rich repeat transmembrane neuronal 2 | SEQ ID NOS: 8053-8055 |
| LRRTM4 | Leucine rich repeat transmembrane neuronal 4 | SEQ ID NOS: 8056-8061 |
| LRTM2 | Leucine-rich repeats and transmembrane domains 2 | SEQ ID NOS: 8062-8066 |
| LSR | Lipolysis stimulated lipoprotein receptor | SEQ ID NOS: 8067-8077 |
| LST1 | Leukocyte specific transcript 1 | SEQ ID NOS: 8078-8095 |
| LTA | Lymphotoxin alpha | SEQ ID NOS: 8096-8097 |
| LTBP1 | Latent transforming growth factor beta binding protein 1 | SEQ ID NOS: 8098-8107 |
| LTBP2 | Latent transforming growth factor beta binding protein 2 | SEQ ID NOS: 8108-8111 |
| LTBP3 | Latent transforming growth factor beta binding protein 3 | SEQ ID NOS: 8112-8124 |
| LTBP4 | Latent transforming growth factor beta binding protein 4 | SEQ ID NOS: 8125-8140 |
| LTBR | Lymphotoxin beta receptor (TNFR superfamily, member 3) | SEQ ID NOS: 8141-8146 |
| LTF | Lactotransferrin | SEQ ID NOS: 8147-8151 |
| LTK | Leukocyte receptor tyrosine kinase | SEQ ID NOS: 8152-8155 |
| LUM | Lumican | SEQ ID NO: 8156 |
| LUZP2 | Leucine zipper protein 2 | SEQ ID NOS: 8157-8160 |
| LVRN | Laeverin | SEQ ID NOS: 8161-8166 |
| LY6E | Lymphocyte antigen 6 complex, locus E | SEQ ID NOS: 8167-8180 |
| LY6G5B | Lymphocyte antigen 6 complex, locus G5B | SEQ ID NOS: 8181-8182 |
| LY6G6D | Lymphocyte antigen 6 complex, locus G6D | SEQ ID NOS: 8183-8184 |
| LY6G6E | Lymphocyte antigen 6 complex, locus G6E (pseudogene) | SEQ ID NOS: 8185-8188 |
| LY6H | Lymphocyte antigen 6 complex, locus H | SEQ ID NOS: 8189-8192 |
| LY6K | lymphocyte antigen 6 complex, locus K | SEQ ID NOS: 8193-8196 |
| RP11-520P18.5 | | SEQ ID NO: 8197 |
| LY86 | Lymphocyte antigen 86 | SEQ ID NOS: 8198-8199 |
| LY96 | Lymphocyte antigen 96 | SEQ ID NOS: 8200-8201 |
| LYG1 | Lysozyme G-like 1 | SEQ ID NOS: 8202-8203 |
| LYG2 | Lysozyme G-like 2 | SEQ ID NOS: 8204-8209 |
| LYNX1 | Ly6/neurotoxin 1 | SEQ ID NOS: 8210-8214 |
| LYPD1 | LY6/PLAUR domain containing 1 | SEQ ID NOS: 8215-8217 |
| LYPD2 | LY6/PLAUR domain containing 2 | SEQ ID NO: 8218 |
| LYPD4 | LY6/PLAUR domain containing 4 | SEQ ID NOS: 8219-8221 |
| LYPD6 | LY6/PLAUR domain containing 6 | SEQ ID NOS: 8222-8226 |
| LYPD6B | LY6/PLAUR domain containing 6B | SEQ ID NOS: 8227-8233 |
| LYPD8 | LY6/PLAUR domain containing 8 | SEQ ID NOS: 8234-8235 |
| LYZ | Lysozyme | SEQ ID NOS: 8236-8238 |
| LYZL4 | Lysozyme-like 4 | SEQ ID NOS: 8239-8240 |
| LYZL6 | Lysozyme-like 6 | SEQ ID NOS: 8241-8243 |
| M6PR | Mannose-6-phosphate receptor (cation dependent) | SEQ ID NOS: 8244-8254 |
| MAD1L1 | MAD1 mitotic arrest deficient-like 1 (yeast) | SEQ ID NOS: 8255-8267 |
| MAG | Myelin associated glycoprotein | SEQ ID NOS: 8268-8273 |
| MAGT1 | Magnesium transporter 1 | SEQ ID NOS: 8274-8277 |
| MALSU1 | Mitochondrial assembly of ribosomal large subunit 1 | SEQ ID NO: 8278 |
| MAMDC2 | MAM domain containing 2 | SEQ ID NO: 8279 |
| MAN2B1 | Mannosidase, alpha, class 2B, member 1 | SEQ ID NOS: 8280-8285 |
| MAN2B2 | Mannosidase, alpha, class 2B, member 2 | SEQ ID NOS: 8286-8288 |
| MANBA | Mannosidase, beta A, lysosomal | SEQ ID NOS: 8289-8302 |
| MANEAL | Mannosidase, endo-alpha-like | SEQ ID NOS: 8303-8307 |
| MANF | Mesencephalic astrocyte-derived neurotrophic factor | SEQ ID NOS: 8308-8309 |
| MANSC1 | MANSC domain containing 1 | SEQ ID NOS: 8310-8313 |
| MAP3K9 | Mitogen-activated protein kinase 9 | SEQ ID NOS: 8314-8319 |
| MASP1 | Mannan-binding lectin serine peptidase 1 (C4/C2 activating component of Ra-reactive factor) | SEQ ID NOS: 8320-8327 |
| MASP2 | Mannan-binding lectin serine peptidase 2 | SEQ ID NOS: 8328-8329 |
| MATN1 | Matrilin 1, cartilage matrix protein | SEQ ID NO: 8330 |
| MATN2 | Matrilin 2 | SEQ ID NOS: 8331-8343 |
| MATN3 | Matrilin 3 | SEQ ID NOS: 8344-8345 |
| MATN4 | Matrilin 4 | SEQ ID NOS: 8346-8350 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| MATR3 | Matrin 3 | SEQ ID NOS: 8351-8378 |
| MAU2 | MAU2 sister chromatid cohesion factor | SEQ ID NOS: 8379-8381 |
| MAZ | MYC-associated zinc finger protein (purine-binding transcription factor) | SEQ ID NOS: 8382-8396 |
| MBD6 | Methyl-CpG binding domain protein 6 | SEQ ID NOS: 8397-8408 |
| MBL2 | Mannose-binding lectin (protein C) 2, soluble | SEQ ID NO: 8409 |
| MBNL1 | Muscleblind-like splicing regulator 1 | SEQ ID NOS: 8410-8428 |
| MCCC1 | Methylcrotonoyl-CoA carboxylase 1 (alpha) | SEQ ID NOS: 8429-8440 |
| MCCD1 | Mitochondrial coiled-coil domain 1 | SEQ ID NO: 8441 |
| MCEE | Methylmalonyl CoA epimerase | SEQ ID NOS: 8442-8445 |
| MCF2L | MCF.2 cell line derived transforming sequence-like | SEQ ID NOS: 8446-8467 |
| MCFD2 | Multiple coagulation factor deficiency 2 | SEQ ID NOS: 8468-8479 |
| MDFIC | MyoD family inhibitor domain containing | SEQ ID NOS: 8480-8487 |
| MDGA1 | MAM domain containing glycosylphosphatidylinositol anchor 1 | SEQ ID NOS: 8488-8493 |
| MDK | Midkine (neurite growth-promoting factor 2) | SEQ ID NOS: 8494-8503 |
| MED20 | Mediator complex subunit 20 | SEQ ID NOS: 8504-8508 |
| MEGF10 | Multiple EGF-like-domains 10 | SEQ ID NOS: 8509-8512 |
| MEGF6 | Multiple EGF-like-domains 6 | SEQ ID NOS: 8513-8516 |
| MEI1 | Meiotic double-stranded break formation protein 1 | SEQ ID NOS: 8517-8520 |
| MEI4 | Meiotic double-stranded break formation protein 4 | SEQ ID NO: 8521 |
| MEIS1 | Meis homeobox 1 | SEQ ID NOS: 8522-8527 |
| MEIS3 | Meis homeobox 3 | SEQ ID NOS: 8528-8537 |
| MFI2 | Antigen p97 (melanoma associated) identified by monoclonal antibodies 133.2 and 96.5 | SEQ ID NOS: 8538-8540 |
| MEPE | Matrix extracellular phosphoglycoprotein | SEQ ID NOS: 8541-8547 |
| MESDC2 | Mesoderm development candidate 2 | SEQ ID NOS: 8548-8552 |
| MEST | Mesoderm specific transcript | SEQ ID NOS: 8553-8566 |
| MET | MET proto-oncogene, receptor tyrosine kinase | SEQ ID NOS: 8567-8572 |
| METRN | Meteorin, glial cell differentiation regulator | SEQ ID NOS: 8573-8577 |
| METRNL | Meteorin, glial cell differentiation regulator-like | SEQ ID NOS: 8578-8581 |
| METTL17 | Methyltransferase like 17 | SEQ ID NOS: 8582-8592 |
| METTL24 | Methyltransferase like 24 | SEQ ID NO: 8593 |
| METTL7B | Methyltransferase like 7B | SEQ ID NOS: 8594-8595 |
| METTL9 | Methyltransferase like 9 | SEQ ID NOS: 8596-8604 |
| MEX3C | Mex-3 RNA binding family member C | SEQ ID NOS: 8605-8607 |
| MFAP2 | Microfibrillar-associated protein 2 | SEQ ID NOS: 8608-8609 |
| MFAP3 | Microfibrillar-associated protein 3 | SEQ ID NOS: 8610-8614 |
| MFAP3L | Microfibrillar-associated protein 3-like | SEQ ID NOS: 8615-8624 |
| MFAP4 | Microfibrillar-associated protein 4 | SEQ ID NOS: 8625-8627 |
| MFAP5 | Microfibrillar associated protein 5 | SEQ ID NOS: 8628-8638 |
| MFGE8 | Milk fat globule-EGF factor 8 protein | SEQ ID NOS: 8639-8645 |
| MFNG | MFNG O-fucosylpeptide 3-beta-N-acetylglucosaminyltransferase | SEQ ID NOS: 8646-8653 |
| MGA | MGA, MAX dimerization protein | SEQ ID NOS: 8654-8662 |
| MGAT2 | Mannosyl (alpha-1,6-)-glycoprotein beta-1,2-N-acetylglucosaminyltransferase | SEQ ID NO: 8663 |
| MGAT3 | Mannosyl (beta-1,4-)-glycoprotein beta-1,4-N-acetylglucosaminyltransferase | SEQ ID NOS: 8664-8666 |
| MGAT4A | Mannosyl (alpha-1,3-)-glycoprotein beta-1,4-N-acetylglucosaminyltransferase, isozyme A | SEQ ID NOS: 8667-8671 |
| MGAT4B | Mannosyl (alpha-1,3-)-glycoprotein beta-1,4-N-acetylglucosaminyltransferase, isozyme B | SEQ ID NOS: 8672-8682 |
| MGAT4D | MGAT4 family, member D | SEQ ID NOS: 8683-8688 |
| MGLL | Monoglyceride lipase | SEQ ID NOS: 8689-8698 |
| MGP | Matrix Gla protein | SEQ ID NOS: 8699-8701 |
| MGST2 | Microsomal glutathione S-transferase 2 | SEQ ID NOS: 8702-8705 |
| MIA | Melanoma inhibitory activity | SEQ ID NOS: 8706-8711 |
| MIA2 | Melanoma inhibitory activity 2 | SEQ ID NO: 8712 |
| MIA3 | Melanoma inhibitory activity family, member 3 | SEQ ID NOS: 8713-8717 |
| MICU1 | Mitochondrial calcium uptake 1 | SEQ ID NOS: 8718-8727 |
| MIER1 | Mesoderm induction early response 1, transcriptional regulator | SEQ ID NOS: 8728-8736 |
| MINOS1-NBL1 | MINOS1-NBL1 readthrough | SEQ ID NOS: 8737-8739 |
| MINPP1 | Multiple inositol-polyphosphate phosphatase 1 | SEQ ID NOS: 8740-8742 |
| MLEC | Malectin | SEQ ID NOS: 8743-8746 |
| MLN | Motilin | SEQ ID NOS: 8747-8749 |
| MLXIP | MLX interacting protein | SEQ ID NOS: 8750-8755 |
| MLXIPL | MLX interacting protein-like | SEQ ID NOS: 8756-8763 |
| MMP1 | Matrix metallopeptidase 1 | SEQ ID NO: 8764 |
| MMP10 | Matrix metallopeptidase 10 | SEQ ID NOS: 8765-8766 |
| MMP11 | Matrix metallopeptidase 11 | SEQ ID NOS: 8767-8770 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| MMP12 | Matrix metallopeptidase 12 | SEQ ID NO: 8771 |
| MMP13 | Matrix metallopeptidase 13 | SEQ ID NOS: 8772-8774 |
| MMP14 | Matrix metallopeptidase 14 (membrane-inserted) | SEQ ID NOS: 8775-8777 |
| MMP17 | Matrix metallopeptidase 17 (membrane-inserted) | SEQ ID NOS: 8778-8785 |
| MMP19 | Matrix metallopeptidase 19 | SEQ ID NOS: 8786-8791 |
| MMP2 | Matrix metallopeptidase 2 | SEQ ID NOS: 8792-8799 |
| MMP20 | Matrix metallopeptidase 20 | SEQ ID NO: 8800 |
| MMP21 | Matrix metallopeptidase 21 | SEQ ID NO: 8801 |
| MMP25 | Matrix metallopeptidase 25 | SEQ ID NOS: 8802-8803 |
| MMP26 | Matrix metallopeptidase 26 | SEQ ID NOS: 8804-8805 |
| MMP27 | Matrix metallopeptidase 27 | SEQ ID NO: 8806 |
| MMP28 | Matrix metallopeptidase 28 | SEQ ID NOS: 8807-8812 |
| MMP3 | Matrix metallopeptidase 3 | SEQ ID NOS: 8813-8815 |
| MMP7 | Matrix metallopeptidase 7 | SEQ ID NO: 8816 |
| MMP8 | Matrix metallopeptidase 8 | SEQ ID NOS: 8817-8822 |
| MMP9 | Matrix metallopeptidase 9 | SEQ ID NO: 8823 |
| MMRN1 | Multimerin 1 | SEQ ID NOS: 8824-8826 |
| MMRN2 | Multimerin 2 | SEQ ID NOS: 8827-8831 |
| MOXD1 | Monooxygenase, DBH-like 1 | SEQ ID NOS: 8832-8834 |
| C6orf25 | Chromosome 6 open reading frame 25 | SEQ ID NOS: 8835-8842 |
| MPO | Myeloperoxidase | SEQ ID NOS: 8843-8844 |
| MPPED1 | Metallophosphoesterase domain containing 1 | SEQ ID NOS: 8845-8848 |
| MPZL1 | Myelin protein zero-like 1 | SEQ ID NOS: 8849-8853 |
| MR1 | Major histocompatibility complex, class I-related | SEQ ID NOS: 8854-8859 |
| MRPL2 | Mitochondrial ribosomal protein L2 | SEQ ID NOS: 8860-8864 |
| MRPL21 | Mitochondrial ribosomal protein L21 | SEQ ID NOS: 8865-8871 |
| MRPL22 | Mitochondrial ribosomal protein L22 | SEQ ID NOS: 8872-8876 |
| MRPL24 | Mitochondrial ribosomal protein L24 | SEQ ID NOS: 8877-8881 |
| MRPL27 | Mitochondrial ribosomal protein L27 | SEQ ID NOS: 8882-8887 |
| MRPL32 | Mitochondrial ribosomal protein L32 | SEQ ID NOS: 8888-8890 |
| MRPL34 | Mitochondrial ribosomal protein L34 | SEQ ID NOS: 8891-8895 |
| MRPL35 | Mitochondrial ribosomal protein L35 | SEQ ID NOS: 8896-8899 |
| MRPL52 | Mitochondrial ribosomal protein L52 | SEQ ID NOS: 8900-8910 |
| MRPL55 | Mitochondrial ribosomal protein L55 | SEQ ID NOS: 8911-8936 |
| MRPS14 | Mitochondrial ribosomal protein S14 | SEQ ID NOS: 8937-8938 |
| MRPS22 | Mitochondrial ribosomal protein S22 | SEQ ID NOS: 8939-8947 |
| MRPS28 | Mitochondrial ribosomal protein S28 | SEQ ID NOS: 8948-8955 |
| MS4A14 | Membrane-spanning 4-domains, subfamily A, member 14 | SEQ ID NOS: 8956-8966 |
| MS4A3 | Membrane-spanning 4-domains, subfamily A, member 3 (hematopoietic cell-specific) | SEQ ID NOS: 8967-8971 |
| MSH3 | MutS homolog 3 | SEQ ID NO: 8972 |
| MSH5 | MutS homolog 5 | SEQ ID NOS: 8973-8984 |
| MSLN | Mesothelin | SEQ ID NOS: 8985-8992 |
| MSMB | Microseminoprotein, beta- | SEQ ID NOS: 8993-8994 |
| MSRA | Methionine sulfoxide reductase A | SEQ ID NOS: 8995-9002 |
| MSRB2 | Methionine sulfoxide reductase B2 | SEQ ID NOS: 9003-9004 |
| MSRB3 | Methionine sulfoxide reductase B3 | SEQ ID NOS: 9005-9018 |
| MST1 | Macrophage stimulating 1 | SEQ ID NOS: 9019-9020 |
| MSTN | Myostatin | SEQ ID NO: 9021 |
| MT1G | Metallothionein 1G | SEQ ID NOS: 9022-9025 |
| MTHFD2 | Methylenetetrahydrofolate dehydrogenase (NADP+ dependent) 2, methenyltetrahydrofolate cyclohydrolase | SEQ ID NOS: 9026-9030 |
| MTMR14 | Myotubularin related protein 14 | SEQ ID NOS: 9031-9041 |
| MTRNR2L11 | MT-RNR2-like 11 (pseudogene) | SEQ ID NO: 9042 |
| MTRR | 5-methyltetrahydrofolate-homocysteine methyltransferase reductase | SEQ ID NOS: 9043-9055 |
| MTTP | Microsomal triglyceride transfer protein | SEQ ID NOS: 9056-9066 |
| MTX2 | Metaxin 2 | SEQ ID NOS: 9067-9071 |
| MUC1 | Mucin 1, cell surface associated | SEQ ID NOS: 9072-9097 |
| MUC13 | Mucin 13, cell surface associated | SEQ ID NOS: 9098-9099 |
| MUC20 | Mucin 20, cell surface associated | SEQ ID NOS: 9100-9104 |
| MUC3A | Mucin 3A, cell surface associated | SEQ ID NOS: 9105-9107 |
| MUC5AC | Mucin 5AC, oligomeric mucus/gel-forming | SEQ ID NO: 9108 |
| MUC5B | Mucin 5B, oligomeric mucus/gel-forming | SEQ ID NOS: 9109-9110 |
| MUC6 | Mucin 6, oligomeric mucus/gel-forming | SEQ ID NOS: 9111-9114 |
| MUC7 | Mucin 7, secreted | SEQ ID NOS: 9115-9118 |
| MUCL1 | Mucin-like 1 | SEQ ID NOS: 9119-9121 |
| MXRA5 | Matrix-remodelling associated 5 | SEQ ID NO: 9122 |
| MXRA7 | Matrix-remodelling associated 7 | SEQ ID NOS: 9123-9129 |
| MYDGF | Myeloid-derived growth factor | SEQ ID NOS: 9130-9132 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| MYL1 | Myosin, light chain 1, alkali; skeletal, fast | SEQ ID NOS: 9133-9134 |
| MYOC | Myocilin, trabecular meshwork inducible glucocorticoid response | SEQ ID NOS: 9135-9136 |
| MYRFL | Myelin regulatory factor-like | SEQ ID NOS: 9137-9141 |
| MZB1 | Marginal zone B and B1 cell-specific protein | SEQ ID NOS: 9142-9146 |
| N4BP2L2 | NEDD4 binding protein 2-like 2 | SEQ ID NOS: 9147-9152 |
| NAA38 | N(alpha)-acetyltransferase 38, NatC auxiliary subunit | SEQ ID NOS: 9153-9158 |
| NAAA | N-acylethanolamine acid amidase | SEQ ID NOS: 9159-9164 |
| NAGA | N-acetylgalactosaminidase, alpha- | SEQ ID NOS: 9165-9167 |
| NAGLU | N-acetylglucosaminidase, alpha | SEQ ID NOS: 9168-9172 |
| NAGS | N-acetylglutamate synthase | SEQ ID NOS: 9173-9174 |
| NAPSA | Napsin A aspartic peptidase | SEQ ID NOS: 9175-9177 |
| CARKD | Carbohydrate kinase domain containing | SEQ ID NOS: 9178-9179 |
| APOA1BP | Apolipoprotein A-I binding protein | SEQ ID NOS: 9180-9182 |
| NBL1 | Neuroblastoma 1, DAN family BMP antagonist | SEQ ID NOS: 9183-9196 |
| NCAM1 | Neural cell adhesion molecule 1 | SEQ ID NOS: 9197-9216 |
| NCAN | Neurocan | SEQ ID NOS: 9217-9218 |
| NCBP2-AS2 | NCBP2 antisense RNA 2 (head to head) | SEQ ID NO: 9219 |
| NCSTN | Nicastrin | SEQ ID NOS: 9220-9229 |
| NDNF | Neuron-derived neurotrophic factor | SEQ ID NOS: 9230-9232 |
| NDP | Norrie disease (pseudoglioma) | SEQ ID NOS: 9233-9235 |
| NDUFA10 | NADH dehydrogenase (ubiquinone) 1 alpha subcomplex, 10, 42 kDa | SEQ ID NOS: 9236-9245 |
| NDUFB5 | NADH dehydrogenase (ubiquinone) 1 beta subcomplex, 5, 16 kDa | SEQ ID NOS: 9246-9254 |
| NDUFS8 | NADH dehydrogenase (ubiquinone) Fe—S protein 8, 23 kDa (NADH-coenzyme Q reductase) | SEQ ID NOS: 9255-9264 |
| NDUFV1 | NADH dehydrogenase (ubiquinone) flavoprotein 1, 51 kDa | SEQ ID NOS: 9265-9278 |
| NECAB3 | N-terminal EF-hand calcium binding protein 3 | SEQ ID NOS: 9279-9288 |
| PVRL1 | Poliovirus receptor-related 1 (herpesvirus entry mediator C) | SEQ ID NOS: 9289-92.91 |
| NELL1 | Neural EGFL like 1 | SEQ ID NOS: 9292-9295 |
| NELL2 | Neural EGFL like 2 | SEQ ID NOS: 9296-9310 |
| NENF | Neudesin neurotrophic factor | SEQ ID NO: 9311 |
| NETO1 | Neuropilin (NRP) and tolloid (TLL)-like 1 | SEQ ID NOS: 9312-9316 |
| NFASC | Neurofascin | SEQ ID NOS: 9317-9331 |
| NFE2L1 | Nuclear factor, erythroid 2-like 1 | SEQ ID NOS: 9332-9350 |
| NFE2L3 | Nuclear factor, erythroid 2-like 3 | SEQ ID NOS: 9351-9352 |
| NGEF | Neuronal guanine nucleotide exchange factor | SEQ ID NOS: 9353-9358 |
| NGF | Nerve growth factor (beta polypeptide) | SEQ ID NO: 9359 |
| NGLY1 | N-glycanase 1 | SEQ ID NOS: 9360-9366 |
| NGRN | Neugrin, neurite outgrowth associated | SEQ ID NOS: 9367-9368 |
| NHLRC3 | NHL repeat containing 3 | SEQ ID NOS: 9369-9371 |
| NID1 | Nidogen 1 | SEQ ID NOS: 9372-9373 |
| NID2 | Nidogen 2 (osteonidogen) | SEQ ID NOS: 9374-9376 |
| NKG7 | Natural killer cell granule protein 7 | SEQ ID NOS: 9377-9381 |
| NLGN3 | Neuroligin 3 | SEQ ID NOS: 9382-9386 |
| NLGN4Y | Neuroligin 4, Y-linked | SEQ ID NOS: 9387-9393 |
| NLRP5 | NLR family, pyrin domain containing 5 | SEQ ID NOS: 9394-9396 |
| NMB | Neuromedin B | SEQ ID NOS: 9397-9398 |
| NME1 | NME/NM23 nucleoside diphosphate kinase 1 | SEQ ID NOS: 9399-9405 |
| NME1-NME2 | NME1-NME2 readthrough | SEQ ID NOS: 9406-9408 |
| NME3 | NME/NM23 nucleoside diphosphate kinase 3 | SEQ ID NOS: 9409-9413 |
| NMS | Neuromedin S | SEQ ID NO: 9414 |
| NMU | Neuromedin U | SEQ ID NOS: 9415-9418 |
| NOA1 | Nitric oxide associated 1 | SEQ ID NO: 9419 |
| NODAL | Nodal growth differentiation factor | SEQ ID NOS: 9420-9421 |
| NOG | Noggin | SEQ ID NO: 9422 |
| NOMO3 | NODAL modulator 3 | SEQ ID NOS: 9423-9429 |
| NOS1AP | Nitric oxide synthase 1 (neuronal) adaptor protein | SEQ ID NOS: 9430-9434 |
| NOTCH3 | Notch 3 | SEQ ID NOS: 9435-9438 |
| NOTUM | Notum pectinacetylesterase homolog (*Drosophila*) | SEQ ID NOS: 9439-9441 |
| NOV | Nephroblastoma overexpressed | SEQ ID NO: 9442 |
| NPB | Neuropeptide B | SEQ ID NOS: 9443-9444 |
| NPC2 | Niemann-Pick disease, type C2 | SEQ ID NOS: 9445-9453 |
| NPFF | Neuropeptide FF-amide peptide precursor | SEQ ID NO: 9454 |
| NPFFR2 | Neuropeptide FF receptor 2 | SEQ ID NOS: 9455-9458 |
| NPHS1 | Nephrosis 1, congenital, Finnish type (nephrin) | SEQ ID NOS: 9459-9460 |
| NPNT | Nephronectin | SEQ ID NOS: 9461-9471 |
| NPPA | Natriuretic peptide A | SEQ ID NOS: 9472-9474 |
| NPPB | Natriuretic peptide B | SEQ ID NO: 9475 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| NPPC | Natriuretic peptide C | SEQ ID NOS: 9476-9477 |
| NPS | Neuropeptide S | SEQ ID NO: 9478 |
| NPTX1 | Neuronal pentraxin I | SEQ ID NO: 9479 |
| NPTX2 | Neuronal pentraxin II | SEQ ID NO: 9480 |
| NPTXR | Neuronal pentraxin receptor | SEQ ID NOS: 9481-9482 |
| NPVF | Neuropeptide VF precursor | SEQ ID NO: 9483 |
| NPW | Neuropeptide W | SEQ ID NOS: 9484-9486 |
| NPY | Neuropeptide Y | SEQ ID NOS: 9487-9489 |
| NQO2 | NAD(P)H dehydrogenase, quinone 2 | SEQ ID NOS: 9490-9498 |
| NRCAM | Neuronal cell adhesion molecule | SEQ ID NOS: 9499-9511 |
| NRG1 | Neuregulin 1 | SEQ ID NOS: 9512-9529 |
| NRN1L | Neuritin 1-like | SEQ ID NOS: 9530-9532 |
| NRP1 | Neuropilin 1 | SEQ ID NOS: 9533-9546 |
| NRP2 | Neuropilin 2 | SEQ ID NOS: 9547-9553 |
| NRTN | Neurturin | SEQ ID NO: 9554 |
| NRXN1 | Neurexin 1 | SEQ ID NOS: 9555-9585 |
| NRXN2 | Neurexin 2 | SEQ ID NOS: 9586-9594 |
| NT5C3A | 5'-nucleotidase, cytosolic IIIA | SEQ ID NOS: 9595-9605 |
| NT5DC3 | 5'-nucleotidase domain containing 3 | SEQ ID NOS: 9606-9608 |
| NT5E | 5'-nucleotidase, ecto (CD73) | SEQ ID NOS: 9609-9613 |
| NTF3 | Neurotrophin 3 | SEQ ID NOS: 9614-9615 |
| NTF4 | Neurotrophin 4 | SEQ ID NOS: 9616-9617 |
| NTM | Neurotrimin | SEQ ID NOS: 9618-9627 |
| NTN1 | Netrin 1 | SEQ ID NOS: 9628-9629 |
| NTN3 | Netrin 3 | SEQ ID NO; 9630 |
| NTN4 | Netrin 4 | SEQ ID NOS: 9631-9635 |
| NTN5 | Netrin 5 | SEQ ID NOS: 9636-9637 |
| NTNG1 | Netrin G1 | SEQ ID NOS: 9638-9644 |
| NTNG2 | Netrin G2 | SEQ ID NOS: 9645-9646 |
| NTS | Neurotensin | SEQ ID NOS: 9647-9648 |
| NUBPL | Nucleotide binding protein-like | SEQ ID NOS: 9649-9655 |
| NUCB1 | Nucleobindin 1 | SEQ ID NOS: 9656-9662 |
| NUCB2 | Nucleobindin 2 | SEQ ID NOS: 9663-9678 |
| NUDT19 | Nudix (nucleoside diphosphate linked moiety X)-type motif 19 | SEQ ID NO: 9679 |
| NUDT9 | Nudix (nucleoside diphosphate linked moiety X)-type motif 9 | SEQ ID NOS: 9680-9684 |
| NUP155 | Nucleoporin 155 kDa | SEQ ID NOS: 9685-9688 |
| NUP214 | Nucleoporin 214 kDa | SEQ ID NOS: 9689-9700 |
| NUP85 | Nucleoporin 85 kDa | SEQ ID NOS: 9701-9715 |
| NXPE3 | Neurexopbilin and PC-esterase domain family, member 3 | SEQ ID NOS: 9716-9721 |
| NXPE4 | Neurexopbilin and PC-esterase domain family, member 4 | SEQ ID NOS: 9722-9723 |
| NXPH1 | Neurexopbilin 1 | SEQ ID NOS: 9724-9727 |
| NXPH2 | Neurexophilin 2 | SEQ ID NO: 9728 |
| NXPH3 | Neurexophilin 3 | SEQ ID NOS: 9729-9730 |
| NXPH4 | Neurexophilin 4 | SEQ ID NOS: 9731-9732 |
| NYX | Nyctalopin | SEQ ID NOS: 9733-9734 |
| OAF | Out at first homolog | SEQ ID NOS: 9735-9736 |
| OBP2A | Odorant binding protein 2A | SEQ ID NOS: 9737-9743 |
| OBP2B | Odorant binding protein 2B | SEQ ID NOS: 9744-9747 |
| OC90 | Otoconin 90 | SEQ ID NO: 9748 |
| OCLN | Occludin | SEQ ID NOS: 9749-9751 |
| ODAM | Odontogenic, ameloblast asssociated | SEQ ID NOS: 9752-9755 |
| C4orf26 | Chromosome 4 open reading frame 26 | SEQ ID NOS: 9756-9759 |
| OGG1 | 8-oxoguanine DMA glycosylase | SEQ ID NOS: 9760-9773 |
| OGN | Osteoglycin | SEQ ID NOS: 9774-9776 |
| OIT3 | Oncoprotein induced transcript 3 | SEQ ID NOS: 9777-9778 |
| OLFM1 | Olfactomedin 1 | SEQ ID NOS: 9779-9789 |
| OLFM2 | Olfactomedin 2 | SEQ ID NOS: 9790-9793 |
| OLFM3 | Olfactomedin 3 | SEQ ID NOS: 9794-9796 |
| OLFM4 | Olfactomedin 4 | SEQ ID NO: 9797 |
| OLFML1 | Olfactomedin-like 1 | SEQ ID NOS: 9798-9801 |
| OLFML2A | Olfactomedin-like 2A | SEQ ID NOS: 9802-9804 |
| OLFML2B | Olfactomedin-like 2B | SEQ ID NOS: 9805-9809 |
| OLFML3 | Olfactomedin-like 3 | SEQ ID NOS: 9810-9812 |
| OMD | Osteomodulin | SEQ ID NO: 9813 |
| OMG | Oligodendrocyte myelin glycoprotein | SEQ ID NO: 9814 |
| OOSP2 | Oocyte secreted protein 2 | SEQ ID NOS: 9815-9816 |
| OPCML | Opioid binding protein/cell adhesion molecule-like | SEQ ID NOS: 9817-9821 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| PROL1 | Proline rich, lacrimal 1 | SEQ ID NO: 9822 |
| OPTC | Opticin | SEQ ID NOS: 9823-9824 |
| ORAI1 | ORAI calcium release-activated calcium modulator 1 | SEQ ID NO: 9825 |
| ORM1 | Orosomucoid 1 | SEQ ID NO: 9826 |
| ORM2 | Orosomucoid 2 | SEQ ID NO: 9827 |
| ORMDL2 | ORMDL sphingolipid biosynthesis regulator 2 | SEQ ID NOS: 9828-9831 |
| OS9 | Osteosarcoma amplified 9, endoplasmic reticulum lectin | SEQ ID NOS: 9832-9846 |
| OSCAR | Osteoclast associated, immunoglobulin-like receptor | SEQ ID NOS: 9847-9857 |
| OSM | Oncostatin M | SEQ ID NOS: 9858-9860 |
| OSMR | Oncostatin M receptor | SEQ ID NOS: 9861-9865 |
| OSTN | Osteocrin | SEQ ID NOS: 9866-9867 |
| OTOA | Otoancorin | SEQ ID NOS: 9868-9873 |
| OTOG | Otogelin | SEQ ID NOS: 9874-9876 |
| OTOGL | Otogelin-like | SEQ ID NOS: 9877-9883 |
| OTOL1 | Otolin 1 | SEQ ID NO: 9884 |
| OTOR | Otoraplin | SEQ ID NO: 9885 |
| OTOS | Otospiralin | SEQ ID NOS: 9886-9887 |
| OVCH1 | Ovochymase 1 | SEQ ID NOS: 9888-9890 |
| OVCH2 | Ovochymase 2 (gene/pseudogene) | SEQ ID NOS: 9891-9892 |
| OVGP1 | Oviductal glycoprotein 1, 120 kDa | SEQ ID NO: 9893 |
| OXCT1 | 3-oxoacid CoA transferase 1 | SEQ ID NOS: 9894-9897 |
| OXCT2 | 3-oxoacid CoA transferase 2 | SEQ ID NO: 9898 |
| OXNAD1 | Oxidoreductase NAD-binding domain containing 1 | SEQ ID NOS: 9899-9905 |
| OXT | Oxytocin/neurophysin I prepropeptide | SEQ ID NO: 9906 |
| P3H1 | Prolyl 3-hydroxylase 1 | SEQ ID NOS: 9907-9911 |
| P3H2 | Prolyl 3-hydroxylase 2 | SEQ ID NOS: 9912-9915 |
| P3H3 | Prolyl 3-hydroxylase 3 | SEQ ID NO: 9916 |
| P3H4 | Prolyl 3-hydroxylase family member 4 (non-enzymatic) | SEQ ID NOS: 9917-9921 |
| P4HA1 | Prolyl 4-hydroxylase, alpha polypeptide I | SEQ ID NOS: 9922-9926 |
| P4HA2 | Prolyl 4-hydroxylase, alpha polypeptide II | SEQ ID NOS: 9927-9941 |
| P4HA3 | Prolyl 4-hydroxylase, alpha polypeptide III | SEQ ID NOS: 9942-9946 |
| P4HB | Prolyl 4-hydroxylase, beta polypeptide | SEQ ID NOS: 9947-9958 |
| PAEP | Progestagen-associated endometrial protein | SEQ ID NOS: 9959-9967 |
| PAM | Peplidylglycine alpha-amidating monooxygenase | SEQ ID NOS: 9968-9981 |
| PAMR1 | Peptidase domain containing associated with muscle regeneration 1 | SEQ ID NOS: 9982-9988 |
| PAPLN | Papilin, proteoglycan-like sulfated glycoprotein | SEQ ID NOS: 9989-9996 |
| PAPPA | Pregnancy-associated plasma protein A, pappalysin 1 | SEQ ID NO: 9997 |
| PAPPA2 | Pappalysin 2 | SEQ ID NOS: 9998-9999 |
| PARP15 | Poly (ADP-ribose) polymerase family, member 15 | SEQ ID NOS: 10000-10003 |
| PARVB | Parvin, beta | SEQ ID NOS: 10004-10008 |
| PATE1 | Prostate and testis expressed 1 | SEQ ID NOS: 10009-10010 |
| PATE2 | Prostate and testis expressed 2 | SEQ ID NOS: 10011-10012 |
| PATE3 | Prostate and testis expressed 3 | SEQ ID NO: 10013 |
| PATE4 | Prostate and testis expressed 4 | SEQ ID NOS: 10014-10015 |
| PATL2 | Protein associated with topoisomerase II homolog 2 (yeast) | SEQ ID NOS: 10016-10021 |
| PAX2 | Paired box 2 | SEQ ID NOS: 10022-10027 |
| PAX4 | Paired box 4 | SEQ ID NOS: 10028-10034 |
| PCCB | Propionyl CoA carboxylase, beta polypeptide | SEQ ID NOS: 10035-10049 |
| PCDH1 | Protocadherin 1 | SEQ ID NOS: 10050-10055 |
| PCDH12 | Protocadherin 12 | SEQ ID NOS: 10056-10057 |
| PCDH15 | Protocadherin-related 15 | SEQ ID NOS: 10058-10091 |
| PCDHA1 | Protocadherin alpha 1 | SEQ ID NOS: 10092-10094 |
| PCDHA10 | Protocadherin alpha 10 | SEQ ID NOS: 10095-10097 |
| PCDHA11 | Protocadherin alpha 11 | SEQ ID NOS: 10098-10100 |
| PCDHA6 | Protocadherin alpha 6 | SEQ ID NOS: 10101-10103 |
| PCDHB12 | Protocadherin beta 12 | SEQ ID NOS: 10104-10106 |
| PCDHGA11 | Protocadherin gamma subfamily A, 11 | SEQ ID NOS: 10107-10109 |
| PCF11 | PCF11 cleavage and polyadenylation factor subunit | SEQ ID NOS: 10110-10114 |
| PCOLCE | Procollagen C-endopeptidase enhancer | SEQ ID NO: 10115 |
| PCOLCE2 | Procollagen C-endopeptidase enhancer 2 | SEQ ID NOS: 10116-10119 |
| PCSK1 | Proprotein convertase subtilisin/kexin type 1 | SEQ ID NOS: 10120-10122 |
| PCSK1N | Proprotein convertase subtilisin/kexin type 1 inhibitor | SEQ ID NO: 10123 |
| PCSK2 | Proprotein convertase subtilisin/kexin type 2 | SEQ ID NOS: 10124-10126 |
| PCSK4 | Proprotein convertase subtilisin/kexin type 4 | SEQ ID NOS: 10127-10129 |
| PCSK5 | Proprotein convertase subtilisin/kexin type 5 | SEQ ID NOS: 10130-10134 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| PCSK9 | Proprotein convertase subtilisin/kexin type 9 | SEQ ID NO: 10135 |
| PCYOX1 | Prenylcysteine oxidase 1 | SEQ ID NOS: 10136-10140 |
| PCYOX1L | Prenylcysteine oxidase 1 like | SEQ ID NOS: 10141-10145 |
| PDE11A | Phosphodiesterase 11A | SEQ ID NOS: 10146-10151 |
| PDE2A | Phosphodiesterase 2A, cGMP-stimulated | SEQ ID NOS: 10152-10173 |
| PDE7A | Phosphodiesterase 7A | SEQ ID NOS: 10174-10177 |
| PDF | Peptide deformylase (mitochondrial) | SEQ ID NO: 10178 |
| PDGFA | Platelet-derived growth factor alpha polypeptide | SEQ ID NOS: 10179-10182 |
| PDGFB | Platelet-derived growth factor beta polypeptide | SEQ ID NOS: 10183-10186 |
| PDGFC | Platelet derived growth factor C | SEQ ID NOS: 10187-10190 |
| PDGFD | Platelet derived growth factor D | SEQ ID NOS: 10191-10193 |
| PDGFRA | Platelet-derived growth factor receptor, alpha polypeptide | SEQ ID NOS: 10194-10200 |
| PDGFRB | Platelet-derived growth factor receptor, beta polypeptide | SEQ ID NOS: 10201-10204 |
| PDGFRL | Platelet-derived growth factor receptor-like | SEQ ID NOS: 10205-10206 |
| PDHA1 | Pyruvate dehydrogenase (lipoamide) alpha 1 | SEQ ID NOS: 10207-10215 |
| PDIA2 | Protein disulfide isomerase family A, member 2 | SEQ ID NOS: 10216-10219 |
| PDIA3 | Protein disulfide isomerase family A, member 3 | SEQ ID NOS: 10220-10223 |
| PDIA4 | Protein disulfide isomerase family A, member 4 | SEQ ID NOS: 10224-10225 |
| PDIA5 | Protein disulfide isomerase family A, member 5 | SEQ ID NOS: 10226-10229 |
| PDIA6 | Protein disulfide isomerase family A, member 6 | SEQ ID NOS: 10230-10236 |
| PDILT | Protein disulfide isomerase-like, testis expressed | SEQ ID NOS: 10237-10238 |
| PDYN | Prodynorphin | SEQ ID NOS: 10239-10241 |
| PDZD8 | PDZ domain containing 8 | SEQ ID NO: 10242 |
| PDZRN4 | PDZ domain containing ring finger 4 | SEQ ID NOS: 10243-10245 |
| PEAR1 | Platelet endothelial aggregation receptor 1 | SEQ ID NOS: 10246-10249 |
| PEBP4 | Phosphatidylethanolamine-binding protein 4 | SEQ ID NOS: 10250-10251 |
| PECAM1 | Platelet/endothelial cell adhesion molecule 1 | SEQ ID NOS: 10252-10255 |
| PENK | Proenkephalin | SEQ ID NOS: 10256-10261 |
| PET117 | PET117 homolog | SEQ ID NO: 10262 |
| PF4 | Platelet factor 4 | SEQ ID NO: 10263 |
| PF4V1 | Platelet factor 4 variant 1 | SEQ ID NO: 10264 |
| PFKP | Phosphofructokinase, platelet | SEQ ID NOS: 10265-10273 |
| PFN1 | Profilin 1 | SEQ ID NOS: 10274-10276 |
| PGA3 | Pepsinogen 3, group I (pepsinogen A) | SEQ ID NOS: 10277-10280 |
| PGA4 | Pepsinogen 4, group I (pepsinogen A) | SEQ ID NOS: 10281-10283 |
| PGA5 | Pepsinogen 5, group I (pepsinogen A) | SEQ ID NOS: 10284-10286 |
| PGAM5 | PGAM family member 5, serine/threonine protein phosphatase, mitochondrial | SEQ ID NOS: 10287-10290 |
| PGAP3 | Post-GPI attachment to proteins 3 | SEQ ID NOS: 10291-10298 |
| PGC | Progastricsin (pepsinogen C) | SEQ ID NOS: 10299-10302 |
| PGF | Placental growth factor | SEQ ID NOS: 10303-10306 |
| PGLYRP1 | Peptidoglycan recognition protein 1 | SEQ ID NO: 10307 |
| PGLYRP2 | Peptidoglycan recognition protein 2 | SEQ ID NOS: 10308-10311 |
| PGLYRP3 | Peptidoglycan recognition protein 3 | SEQ ID NO: 10312 |
| PGLYRP4 | Peptidoglycan recognition protein 4 | SEQ ID NOS: 10313-10314 |
| PHACTR1 | Phosphatase and actin regulator 1 | SEQ ID NOS: 10315-10321 |
| PHB | Prohibitin | SEQ ID NOS: 10322-10330 |
| PI15 | Peptidase inhibitor 15 | SEQ ID NOS: 10331-10332 |
| PI3 | Peptidase inhibitor 3, skin-derived | SEQ ID NO: 10333 |
| PIANP | PILR alpha associated neural protein | SEQ ID NOS: 10334-10339 |
| PICK | Phosphatidylinositol glycan anchor biosynthesis, class K | SEQ ID NOS: 10340-10343 |
| PIGL | Phosphatidylinositol glycan anchor biosynthesis, class L | SEQ ID NOS: 10344-10351 |
| PIGT | Phosphatidylinositol glycan anchor biosynthesis, class T | SEQ ID NOS: 10352-10406 |
| PIGZ | Phosphatidylinositol glycan anchor biosynthesis, class Z | SEQ ID NOS: 10407-10409 |
| PIK3AP1 | Phosphoinositide-3-kinase adaptor protein 1 | SEQ ID NOS: 10410-10412 |
| PIK3IP1 | Phosphoinositide-3-kinase interacting protein 1 | SEQ ID NOS: 10413-10416 |
| PILRA | Paired immunoglobin-like type 2 receptor alpha | SEQ ID NOS: 10417-10421 |
| PILRB | Paired immunoglobin-like type 2 receptor beta | SEQ ID NOS: 10422-10433 |
| PINLYP | Phospholipase A2 inhibitor and LY6/PLAUR domain containing | SEQ ID NOS: 10434-10438 |
| PIP | Prolactin-induced protein | SEQ ID NO: 10439 |
| PIWIL4 | Piwi-like RNA-mediated gene silencing 4 | SEQ ID NOS: 10440-10444 |
| PKDCC | Protein kinase domain containing, cytoplasmic | SEQ ID NOS: 10445-10446 |
| PKHD1 | Polycystic kidney and hepatic disease 1 (autosomal recessive) | SEQ ID NOS: 10447-10448 |
| PLA1A | Phospholipase A1 member A | SEQ ID NOS: 10449-10453 |
| PLA2G10 | Phospholipase A2, group X | SEQ ID NOS: 10454-10455 |
| PLA2G12A | Phospholipase A2, group XIIA | SEQ ID NOS: 10456-10458 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| PLA2G12B | Phospholipase A2, group XIIB | SEQ ID NO: 10459 |
| PLA2G15 | Phospholipase A2, group XV | SEQ ID NOS: 10460-10467 |
| PLA2G1B | Phospholipase A2, group IB (pancreas) | SEQ ID NOS: 10468-10470 |
| PLA2G2A | Phospholipase A2, group IIA (platelets, synovial fluid) | SEQ ID NOS: 10471-10472 |
| PLA2G2C | Phospholipase A2, group IIC | SEQ ID NOS: 10473-10474 |
| PLA2G2D | Phospholipase A2, group IID | SEQ ID NOS: 10475-10476 |
| PLA2G2E | Phospholipase A2, group IIE | SEQ ID NO: 10477 |
| PLA2G3 | Phospholipase A2, group III | SEQ ID NO: 10478 |
| PLA2G5 | Phospholipase A2, group V | SEQ ID NO: 10479 |
| PLA2G7 | Phospholipase A2, group VII (platelet-activating factor acetylhydrolase, plasma) | SEQ ID NOS: 10480-10481 |
| PLA2R1 | Phospholipase A2 receptor 1, 180 kDa | SEQ ID NOS: 10482-10483 |
| PLAC1 | Placenta-specific 1 | SEQ ID NO: 10484 |
| PLAC9 | Placenta-specific 9 | SEQ ID NOS: 10485-10487 |
| PLAT | Plasminogen activator, tissue | SEQ ID NOS: 10488-10496 |
| PLAU | Plasminogen activator, urokinase | SEQ ID NOS: 10497-10499 |
| PLAUR | Plasminogen activator, urokinase receptor | SEQ ID NOS: 10500-10511 |
| PLBD1 | Phospholipase B domain containing 1 | SEQ ID NOS: 10512-10514 |
| PLBD2 | Phospholipase B domain containing 2 | SEQ ID NOS: 10515-10517 |
| PLG | Plasminogen | SEQ ID NOS: 10518-10520 |
| PLGLB1 | Plasminogen-like B1 | SEQ ID NOS: 10521-10524 |
| PLGLB2 | Plasminogen-like B2 | SEQ ID NOS: 10525-10526 |
| PLOD1 | Procollagen-lysine, 2-oxoglutarate 5-dioxygenase 1 | SEQ ID NOS: 10527-10529 |
| PLOD2 | Procollagen-lysine, 2-oxoglutarate 5-dioxygenase 2 | SEQ ID NOS: 10530-10535 |
| PLOD3 | Procollagen-lysine, 2-oxoglutarate 5-dioxygenase 3 | SEQ ID NOS: 10536-10542 |
| PLTP | Phospholipid transfer protein | SEQ ID NOS: 10543-10547 |
| PLXNA4 | Plexin A4 | SEQ ID NOS: 10548-10551 |
| PLXNB2 | Plexin B2 | SEQ ID NOS: 10552-10560 |
| PM20D1 | Peptidase M20 domain containing 1 | SEQ ID NO: 10561 |
| PMCH | Pro-melanin-concentrating hormone | SEQ ID NO: 10562 |
| PMEL | Premelanosorne protein | SEQ ID NOS: 10563-10574 |
| PMEPA1 | Prostate transmembrane protein, androgen induced 1 | SEQ ID NOS: 10575-10581 |
| PNLIP | Pancreatic lipase | SEQ ID NO: 10582 |
| PNLIPRP1 | Pancreatic lipase-related protein 1 | SEQ ID NOS: 10583-10591 |
| PNLIPRP3 | Pancreatic lipase-related protein 3 | SEQ ID NO: 10592 |
| FNOC | Prepronociceptin | SEQ ID NOS: 10593-10595 |
| PNP | Purine nucleoside phosphorylase | SEQ ID NOS: 10596-10599 |
| PNPLA4 | Patatin-like phospholipase domain containing 4 | SEQ ID NOS: 10600-10603 |
| PODNL1 | Podocan-like 1 | SEQ ID NOS: 10604-10615 |
| POFUT1 | Protein O-fucosyltransferase 1 | SEQ ID NOS: 10616-10617 |
| POFUT2 | Protein O-fucosyltransferase 2 | SEQ ID NOS: 10618-10623 |
| POGLUT1 | Protein O-glucosyltransferase 1 | SEQ ID NOS: 10624-10628 |
| POLL | Polymerase (DNA directed), lambda | SEQ ID NOS: 10629-10641 |
| POMC | Proopiomelanocortin | SEQ ED NOS: 10642-10646 |
| POMGNT2 | Protein O-linked mannose N-acetylglucosaminyltransferase 2 (beta 1,4-) | SEQ ID NOS: 10647-10648 |
| PON1 | Paraoxonase 1 | SEQ ID NOS: 10649-10650 |
| PON2 | Paraoxonase 2 | SEQ ID NOS: 10651-10663 |
| PON3 | Paraoxonase 3 | SEQ ID NOS: 10664-10669 |
| POSTN | Periostin, osteoblast specific factor | SEQ ID NOS: 10670-10675 |
| PPBP | Pro-platelet basic protein (chemokine (C-X-C motif) ligand 7) | SEQ ID NO: 10676 |
| PPIB | Peptidylprolyl isomerase B (cyclophilin B) | SEQ ID NO: 10677 |
| PPIC | Peptidylprolyl isomerase C (cyclophilin C) | SEQ ID NO: 10678 |
| PPOX | Protoporphyrinogen oxidase | SEQ ID NOS: 10679-10689 |
| PPP1CA | Protein phosphatase 1, catalytic subunit, alpha isozyme | SEQ ID NOS: 10690-10695 |
| PPT1 | Palmitoyl-protein thioesterase 1 | SEQ ID NOS: 10696-10712 |
| PPT2 | Palmitoyl-protein thioesterase 2 | SEQ ID NOS: 10713-10720 |
| PPY | Pancreatic polypeptide | SEQ ID NOS: 10721-10725 |
| PRAC2 | Prostate cancer susceptibility candidate 2 | SEQ ID NOS: 10726-10727 |
| PRADC1 | Protease-associated domain containing 1 | SEQ ID NO: 10728 |
| PRAP1 | Proline-rich acidic protein 1 | SEQ ID NOS: 10729-10730 |
| PRB1 | Proline-rich protein BstNI subfamily 1 | SEQ ID NOS: 10731-10734 |
| PRB2 | Proline-rich protein BstNI subfamily 2 | SEQ ID NOS: 10735-10736 |
| PRB3 | Proline-rich protein BstNI subfamily 3 | SEQ ID NOS: 10737-10738 |
| PRB4 | Proline-rich protein BstNI subfamily 4 | SEQ ID NOS: 10739-10742 |
| PRCD | Progressive rod-cone degeneration | SEQ ID NOS: 10743-10744 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| PRCP | Prolylcarboxypeptidase (angiotensinase C) | SEQ ID NOS: 10745-10756 |
| PRDM12 | PR domain containing 12 | SEQ ID NO: 10757 |
| PRDX4 | Peroxiredoxin 4 | SEQ ID NOS: 10758-10761 |
| PRELP | Proline/arginine-rich end leucine-rich repeat protein | SEQ ID NO: 10762 |
| PRF1 | Perforin 1 (pore forming protein) | SEQ ID NOS: 10763-10765 |
| PRG2 | Proteoglycan 2, bone marrow (natural killer cell activator, eosinophil granule major basic protein) | SEQ ID NOS: 10766-10768 |
| PRG3 | Proteoglycan 3 | SEQ ID NO: 10769 |
| PRG4 | Proteoglycan 4 | SEQ ID NOS: 10770-10775 |
| PRH1 | Proline-rich protein HaeIII subfamily 1 | SEQ ID NOS: 10776-10778 |
| PRH2 | Proline-rich protein HaeIII subfamily 2 | SEQ ID NOS: 10779-10780 |
| PRKAG1 | Protein kinase, AMP-activated, gamma 1 non-catalytic subunit | SEQ ID NOS: 10781-10795 |
| PRKCSH | Protein kinase C substrate 80K-H | SEQ ID NOS: 10796-10805 |
| PRKD1 | Protein kinase D1 | SEQ ID NOS: 10806-10811 |
| PRL | Prolactin | SEQ ID NOS: 10812-10814 |
| PRLH | Prolactin releasing hormone | SEQ ID NO: 10815 |
| PRLR | Prolactin receptor | SEQ ID NOS: 10816-10834 |
| PRNP | Prion protein | SEQ ID NOS: 10835-10838 |
| PRNT | Prion protein (testis specific) | SEQ ID NO: 10839 |
| PROC | Protein C (inactivator of coagulation factors Va and VIIIa) | SEQ ID NOS: 10840-10847 |
| PROK1 | Prokineticin 1 | SEQ ID NO: 10848 |
| PROK2 | Prokineticin 2 | SEQ ID NOS: 10849-10850 |
| PROM1 | Prominin 1 | SEQ ID NOS: 10851-10862 |
| PROS1 | Protein S (alpha) | SEQ ID NOS: 10863-10866 |
| PROZ | Protein Z, vitamin K-dependent plasma glycoprotein | SEQ ID NOS: 10867-10868 |
| PRR27 | Proline rich 27 | SEQ ID NOS: 10869-10872 |
| PRR4 | Proline rich 4 (lacrimal) | SEQ ID NOS: 10873-10875 |
| PRRG2 | Proline rich Gla (G-carboxyglutamic acid) 2 | SEQ ID NOS: 10876-10878 |
| PRRT3 | Proline-rich transmembrane protein 3 | SEQ ID NOS: 10879-10881 |
| PRRT4 | Proline-rich transmembrane protein 4 | SEQ ID NOS: 10882-10888 |
| PRSS1 | Protease, serine, 1 (trypsin 1) | SEQ ID NOS: 10889-10892 |
| PRSS12 | Protease, serine, 12 (neurotrypsin, motopsin) | SEQ ID NO: 10893 |
| PRSS16 | Protease, serine, 16 (thymus) | SEQ ID NOS: 10894-10901 |
| PRSS2 | Protease, serine, 2 (trypsin 2) | SEQ ID NOS: 10902-10905 |
| PRSS21 | Protease, serine, 21 (testisin) | SEQ ID NOS: 10906-10911 |
| PRSS22 | Protease, serine, 22 | SEQ ID NOS: 10912-10914 |
| PRSS23 | Protease, serine, 23 | SEQ ID NOS: 10915-10918 |
| PRSS27 | Protease, serine 27 | SEQ ID NOS: 10919-10921 |
| PRSS3 | Protease, serine, 3 | SEQ ID NOS: 10922-10926 |
| PRSS33 | Protease, serine, 33 | SEQ ID NOS: 10927-10930 |
| PRSS35 | Protease, serine, 35 | SEQ ID NO: 10931 |
| PRSS36 | Protease, serine, 36 | SEQ ID NOS: 10932-10935 |
| PRSS37 | Protease, serine, 37 | SEQ ID NOS: 10936-10939 |
| PRSS38 | Protease, serine, 38 | SEQ ID NO: 10940 |
| PRSS42 | Protease, serine, 42 | SEQ ID NOS: 10941-10942 |
| PRSS48 | Protease, serine, 48 | SEQ ID NOS: 10943-10944 |
| PRSS50 | Protease, serine, 50 | SEQ ID NO: 10945 |
| PRSS53 | Protease, serine, 53 | SEQ ID NO: 10946 |
| PRSS54 | Protease, serine, 54 | SEQ ID NOS: 10947-10951 |
| PRSS55 | Protease, serine, 55 | SEQ ID NOS: 10952-10954 |
| PRSS56 | Protease, serine, 56 | SEQ ID NOS: 10955-10956 |
| PRSS57 | Protease, serine, 57 | SEQ ID NOS: 10957-10958 |
| PRSS58 | Protease, serine, 58 | SEQ ID NOS: 10959-10960 |
| PRSS8 | Protease, serine, 8 | SEQ ID NOS: 10961-10964 |
| PRTG | Protogenin | SEQ ID NOS: 10965-10968 |
| PRTN3 | Proteinase 3 | SEQ ID NOS: 10969-10970 |
| PSAP | Prosaposin | SEQ ID NOS: 10971-10974 |
| PSAPL1 | Prosaposin-like 1 (gene/pseudogene) | SEQ ID NO: 10975 |
| PSG1 | Pregnancy specific beta-1-glycoprotein 1 | SEQ ID NOS: 10976-10983 |
| PSG11 | Pregnancy specific beta-1-glycoprotein 11 | SEQ ID NOS: 10984-10988 |
| PSG2 | Pregnancy specific beta-1-glycoprotein 2 | SEQ ID NOS: 10989-10990 |
| PSG3 | Pregnancy specific beta-1-glycoprotein 3 | SEQ ID NOS: 10991-10994 |
| PSG4 | Pregnancy specific beta-1-glycoprotein 4 | SEQ ID NOS: 10995-11006 |
| PSG5 | Pregnancy specific beta-1-glycoprotein 5 | SEQ ID NOS: 11007-11012 |
| PSG6 | Pregnancy specific beta-1-glycoprotein 6 | SEQ ID NOS: 11013-11018 |
| PSG7 | Pregnancy specific beta-1-glycoprotein 7 (gene/pseudogene) | SEQ ID NOS: 11019-11021 |
| PSG8 | Pregnancy specific beta-1-glycoprotein 8 | SEQ ID NOS: 11022-11026 |
| PSG9 | Pregnancy specific beta-1-glycoprotein 9 | SEQ ID NOS: 11027-11034 |
| PSMD1 | Proteasome 26S subunit, non-ATPase 1 | SEQ ID NOS: 11035-11042 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| PSORS1C2 | Psoriasis susceptibility 1 candidate 2 | SEQ ID NO: 11043 |
| PSPN | Persephin | SEQ ID NOS: 11044-11045 |
| PTGDS | Prostaglandin D2 synthase 21 kDa (brain) | SEQ ID NOS: 11046-11050 |
| PTGIR | Prostaglandin I2 (prostacyclin) receptor (IP) | SEQ ID NOS: 11051-11055 |
| PTGS1 | Prostaglandin-endoperoxide synthase 1 (prostaglandin G/H synthase and cyclooxygenase) | SEQ ID NOS: 11056-11064 |
| PTGS2 | Prostaglandin-endoperoxide synthase 2 (prostaglandin G/H synthase and cyclooxygenase) | SEQ ID NOS: 11065-11066 |
| PTH | Parathyroid hormone | SEQ ID NOS: 11067-11068 |
| PTH2 | Parathyroid hormone 2 | SEQ ID NO: 11069 |
| PTHLH | Parathyroid hormone-like hormone | SEQ ID NOS: 11070-11078 |
| PTK7 | Protein tyrosine kinase 7 (inactive) | SEQ ID NOS: 11079-11094 |
| PTN | Pleiotrophin | SEQ ID NOS: 11095-11096 |
| PTPRA | Protein tyrosine phosphatase, receptor type, A | SEQ ID NOS: 11097-11104 |
| PTPRB | Protein tyrosine phosphatase, receptor type, B | SEQ ID NOS: 11105-11112 |
| PTPRC | Protein tyrosine phosphatase, receptor type, C | SEQ ID NOS: 11113-11123 |
| PTPRCAP | Protein tyrosine phosphatase, receptor type, C-associated protein | SEQ ID NO: 11124 |
| PTPRD | Protein tyrosine phosphatase, receptor type, D | SEQ ID NOS: 11125-11136 |
| PTPRF | Protein tyrosine phosphatase, receptor type, F | SEQ ID NOS: 11137-11144 |
| PTPRJ | Protein tyrosine phosphatase, receptor type, J | SEQ ID NOS: 11145-11150 |
| PTPRO | Protein tyrosine phosphatase, receptor type. O | SEQ ID NOS: 11151-11159 |
| PTPRS | Protein tyrosine phosphatase, receptor type, S | SEQ ID NOS: 11160-11167 |
| PTTG1IP | Pituitary tumor-transforming 1 interacting protein | SEQ ID NOS: 11168-11171 |
| PTX3 | Pentraxin 3, long | SEQ ID NO: 11172 |
| PTX4 | Pentraxin 4, long | SEQ ID NOS: 11173-11175 |
| PVR | Poliovirus receptor | SEQ ID NOS: 11176-11181 |
| PXDN | Peroxidasin | SEQ ID NOS: 11182-11186 |
| PXDNL | Peroxidasin-like | SEQ ID NOS: 11187-11189 |
| PXYLP1 | 2-phosphoxylose phosphatase 1 | SEQ ID NOS: 11190-11202 |
| PYY | Peptide YY | SEQ ID NOS: 11203-11204 |
| PZP | Pregnancy-zone protein | SEQ ID NOS: 11205-11206 |
| QPCT | Glutaminyl-peptide cyclotransferase | SEQ ID NOS: 11207-11209 |
| QPRT | Quinolinate phosphoribosyltransferase | SEQ ID NOS: 11210-11211 |
| QRFP | Pyroglutamylated RFamide peptide | SEQ ID NOS: 11212-11213 |
| QSOX1 | Quiescin Q6 sulfhydryl oxidase 1 | SEQ ID NOS: 11214-11217 |
| R3HDML | R3H domain containing-like | SEQ ID NO: 11218 |
| RAB26 | RAB26, member RAS oncogene family | SEQ ID NOS: 11219-11222 |
| RAB36 | RAB36, member RAS oncogene family | SEQ ID NOS: 11223-11225 |
| RAB9B | RAB9B, member RAS oncogene family | SEQ ID NO: 11226 |
| RAET1E | Retinoic acid early transcript 1E | SEQ ID NOS: 11227-11232 |
| RAET1G | Retinoic acid early transcript 1G | SEQ ID NOS: 11233-11235 |
| RAMP2 | Receptor (G protein-coupled) activity modifying protein 2 | SEQ ID NOS: 11236-11240 |
| RAPGEF5 | Rap guanine nucleotide exchange factor (GEF) 5 | SEQ ID NOS: 11241-11247 |
| RARRES1 | Retinoic acid receptor responder (tazarotene induced) 1 | SEQ ID NOS: 11248-11249 |
| RARRES2 | Retinoic acid receptor responder (tazarotene induced) 2 | SEQ ID NOS: 11250-11253 |
| RASA2 | RAS p21 protein activator 2 | SEQ ID NOS: 11254-11256 |
| RBM3 | RNA binding motif (RNP1, RRM) protein 3 | SEQ ID NOS: 11257-11259 |
| RBP3 | Retinol binding protein 3, interstitial | SEQ ID NO: 11260 |
| RBP4 | Retinol binding protein 4, plasma | SEQ ID NOS: 11261-11264 |
| RCN1 | Reticulocalbin 1, EF-hand calcium binding domain | SEQ ID NOS: 11265-11268 |
| RCN2 | Reticulocalbin 2, EF-hand calcium binding domain | SEQ ID NOS: 11269-11272 |
| RCN3 | Reticulocalbin 3, EF-hand calcium binding domain | SEQ ID NOS: 11273-11276 |
| RCOR1 | REST corepressor 1 | SEQ ID NOS: 11277-11278 |
| RDH11 | Retinol dehydrogenase 11 (all-trans/9-cis/11-cis) | SEQ ID NOS: 11279-11286 |
| RDH12 | Retinol dehydrogenase 12 (all-trans/9-cis/11-cis) | SEQ ID NOS: 11287-11288 |
| RDH13 | Retinol dehydrogenase 13 (all-trans/9-cis) | SEQ ID NOS: 11289-11297 |
| RDH5 | Retinol dehydrogenase 5 (11-cis/9-cis) | SEQ ID NOS: 11298-11302 |
| RDH8 | Retinol dehydrogenase 8 (all-trans) | SEQ ID NOS: 11303-11304 |
| REG1A | Regenerating islet-derived 1 alpha | SEQ ID NO: 11305 |
| REG1B | Regenerating islet-derived 1 beta | SEQ ID NOS: 11306-11307 |
| REG3A | Regenerating islet-derived 3 alpha | SEQ ID NOS: 11308-11310 |
| REG3G | Regenerating islet-derived 3 gamma | SEQ ID NOS: 11311-11313 |
| REG4 | Regenerating islet-derived family, member 4 | SEQ ID NOS: 11314-11317 |
| RELN | Reelin | SEQ ID NOS: 11318-11321 |
| RELT | RELT tumor necrosis factor receptor | SEQ ID NOS: 11322-11325 |
| REN | Renin | SEQ ID NOS: 11326-11327 |
| REPIN1 | Replication initiator 1 | SEQ ID NOS: 11328-11341 |
| REPS2 | RALBP1 associated Eps domain containing 2 | SEQ ID NOS: 11342-11343 |
| RET | Ret proto-oncogene | SEQ ID NOS: 11344-11349 |
| RETN | Resistin | SEQ ID NOS: 11350-11352 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| RETNLB | Resistin like beta | SEQ ID NO: 11353 |
| RETSAT | Retinol saturase (all-trans-retinol 13,14-reductase) | SEQ ID NOS: 11354-11358 |
| RFNG | RFNG O-fucosylpeptide 3-beta-N-acetylglucosaminyltransferase | SEQ ID NOS: 11359-11361 |
| RGCC | Regulator of cell cycle | SEQ ID NO: 11362 |
| RGL4 | Ral guanine nucleotide dissociation stimulator-like 4 | SEQ ID NOS: 11363-11369 |
| RGMA | Repulsive guidance molecule family member a | SEQ ID NOS: 11370-11379 |
| RGMB | Repulsive guidance molecule family member b | SEQ ID NOS: 11380-11381 |
| RHOQ | Ras homolog family member Q | SEQ ID NOS: 11382-11386 |
| RIC3 | RIC3 acetylcholine receptor chaperone | SEQ ID NOS: 11387-11394 |
| HRSP12 | Heat-responsive protein 12 | SEQ ID NOS: 11395-11398 |
| RIMS1 | Regulating synaptic membrane exocytosis 1 | SEQ ID NOS: 11399-11414 |
| RIPPLY1 | Ripply transcriptional repressor 1 | SEQ ID NOS: 11415-11416 |
| RLN1 | Relaxin 1 | SEQ ID NO: 11417 |
| RLN2 | Relaxin 2 | SEQ ID NOS: 11418-11419 |
| RLN3 | Relaxin 3 | SEQ ID NOS: 11420-11421 |
| RMDN1 | Regulator of microtubule dynamics 1 | SEQ ID NOS: 11422-11435 |
| RNASE1 | Ribonuclease, RNase A family, 1 (pancreatic) | SEQ ID NOS: 11436-11440 |
| RNASE10 | Ribonuclease, RNase A family, 10 (non-active) | SEQ ID NOS: 11441-11442 |
| RNASE11 | Ribonuclease, RNase A family, 11 (non-active) | SEQ ID NOS: 11443-11453 |
| RNASE12 | Ribonuclease, RNase A family, 12 (non-active) | SEQ ID NO: 11454 |
| RNASE13 | Ribonuclease, RNase A family, 13 (non-active) | SEQ ID NO: 11455 |
| RNASE2 | Ribonuclease, RNase A family, 2 (liver, eosinophil-derived neurotoxin) | SEQ ID NO: 11456 |
| RNASE3 | Ribonuclease, RNase A family, 3 | SEQ ID NO: 11457 |
| RNASE4 | Ribonuclease, RNase A family, 4 | SEQ ID NOS: 11458-11460 |
| RNASE6 | Ribonuclease, RNase A family, k6 | SEQ ID NO: 11461 |
| RNASE7 | Ribonuclease, RNase A family, 7 | SEQ ID NOS: 11462-11463 |
| RNASE8 | Ribonuclease, RNase A family, 8 | SEQ ID NO: 11464 |
| RNASE9 | Ribonuclease, RNase A family, 9 (non-active) | SEQ ID NOS: 11465-11475 |
| RNASEH1 | Ribonuclease H1 | SEQ ID NOS: 11476-11478 |
| RNASET2 | Ribonuclease T2 | SEQ ID NOS: 11479-11486 |
| RNF146 | Ring finger protein 146 | SEQ ID NOS: 11487-11498 |
| RNF148 | Ring finger protein 148 | SEQ ID NOS: 11499-11500 |
| RNF150 | Ring finger protein 150 | SEQ ID NOS: 11501-11505 |
| RNF167 | Ring finger protein 167 | SEQ ID NOS: 11506-11516 |
| RNF220 | Ring finger protein 220 | SEQ ID NOS: 11517-11523 |
| RNF34 | Ring finger protein 34, E3 ubiquitin protein ligase | SEQ ID NOS: 11524-11531 |
| RNLS | Renalase, FAD-dependent amine oxidase | SEQ ID NOS: 11532-11534 |
| RNPEP | Arginyl aminopeptidase (aminopeptidase B) | SEQ ID NOS: 11535-11540 |
| ROR1 | Receptor tyrosine kinase-like orphan receptor 1 | SEQ ID NOS: 11541-11543 |
| RPL3 | Ribosomal protein L3 | SEQ ID NOS: 11544-11549 |
| RPLP2 | Ribosomal protein, large, P2 | SEQ ID NOS: 11550-11552 |
| RPN2 | Ribophorin II | SEQ ID NOS: 11553-11559 |
| RPS27L | Ribosomal protein S27-like | SEQ ID NOS: 11560-11565 |
| RS1 | Retinoschisin 1 | SEQ ID NO: 11566 |
| RSF1 | Remodeling and spacing factor 1 | SEQ ID NOS: 11567-11573 |
| RSPO1 | R-spondin 1 | SEQ ID NOS: 11574-11577 |
| RSPO2 | R-spondin 2 | SEQ ID NOS: 11578-11585 |
| RSPO3 | R-spondin 3 | SEQ ID NOS: 11586-11587 |
| RSPO4 | R-spondin 4 | SEQ ID NOS: 11588-11589 |
| RSPRY1 | Ring finger and SPRY domain containing 1 | SEQ ID NOS: 11590-11596 |
| RTBDN | Retbindin | SEQ ID NOS: 11597-11609 |
| RTN4RL1 | Reticulon 4 receptor-like 1 | SEQ ID NO: 11610 |
| RTN4RL2 | Reticulon 4 receptor-like 2 | SEQ ID NOS: 11611-11613 |
| SAA1 | Serum amyloid A1 | SEQ ID NOS: 11614-11616 |
| SAA2 | Serum amyloid A2 | SEQ ID NOS: 11617-11622 |
| SAA4 | Serum amyloid A4, constitutive | SEQ ID NO: 11623 |
| SAP30 | Sin3A-associated protein, 30 kDa | SEQ ID NO: 11624 |
| SAR1A | Secretion associated, Ras related GTPase 1A | SEQ ID NOS: 11625-11631 |
| SARAF | Store-operated calcium entry-associated regulatory factor | SEQ ID NOS: 11632-11642 |
| SARM1 | Sterile alpha and TIR motif containing 1 | SEQ ID NOS: 11643-11646 |
| SATB1 | SATB homeobox 1 | SEQ ID NOS: 11647-11659 |
| SAXO2 | Stabilizer of axonemal microtubules 2 | SEQ ID NOS: 11660-11664 |
| SBSN | Suprabasin | SEQ ID NOS: 11665-11667 |
| SBSPON | Somatomedin B and thrombospondin, type 1 domain containing | SEQ ID NO: 11668 |
| SCARF1 | Scavenger receptor class F, member 1 | SEQ ID NOS: 11669-11673 |
| SCG2 | Secretogranin II | SEQ ID NOS: 11674-11676 |
| SCG3 | Secretogranin III | SEQ ID NOS: 11677-11679 |
| SCG5 | Secretogranin V | SEQ ID NOS: 11680-11684 |
| SCGB1A1 | Secretoglobin, family 1A, member 1 (uteroglobin) | SEQ ID NOS: 11685-11686 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| SCGB1C1 | Secretoglobin, family 1C, member 1 | SEQ ID NO: 11687 |
| SCGB1C2 | Secretoglobin, family 1C, member 2 | SEQ ID NO: 11688 |
| SCGB1D1 | Secretoglobin, family 1D, member 1 | SEQ ID NO: 11689 |
| SCGB1D2 | Secretoglobin, family 1D, member 2 | SEQ ID NO: 11690 |
| SCGB1D4 | Secretoglobin, family 1D, member 4 | SEQ ID NO: 11691 |
| SCGB2A1 | Secretoglobin, family 2A, member 1 | SEQ ID NO: 11692 |
| SCGB2A2 | Secretoglobin, family 2A, member 2 | SEQ ID NOS: 11693-11694 |
| SCGB2B2 | Secretoglobin, family 2B, member 2 | SEQ ID NOS: 11695-11696 |
| SCGB3A1 | Secretoglobin, family 3A, member 1 | SEQ ID NO: 11697 |
| SCGB3A2 | Secretoglobin, family 3A, member 2 | SEQ ID NOS: 11698-11699 |
| SCN1B | Sodium channel, voltage gated, type I beta subunit | SEQ ID NOS: 11700-11705 |
| SCN3B | Sodium channel, voltage gated, type III beta subunit | SEQ ID NOS: 11706-11710 |
| SCPEP1 | Serine carboxypeptidase 1 | SEQ ID NOS: 11711-11718 |
| SCRG1 | Stimulator of chondrogenesis 1 | SEQ ID NOS: 11719-11720 |
| SCT | Secretin | SEQ ID NO: 11721 |
| SCUBE1 | Signal peptide, CUB domain, EGF-like 1 | SEQ ID NOS: 11722-11725 |
| SCUBE2 | Signal peptide, CUB domain, EGF-like 2 | SEQ ID NOS: 11726-11732 |
| SCUBE3 | Signal peptide, CUB domain, EGF-like 3 | SEQ ID NO: 11733 |
| SDC1 | Syndecan 1 | SEQ ID NOS: 11734-11738 |
| SDF2 | Stromal cell-derived factor 2 | SEQ ID NOS: 11739-11741 |
| SDF2L1 | Stromal cell-derived factor 2-like 1 | SEQ ID NO: 11742 |
| SDF4 | Stromal cell derived factor 4 | SEQ ID NOS: 11743-11746 |
| SDHAF2 | Succinate dehydrogenase complex assembly factor 2 | SEQ ID NOS: 11747-11754 |
| SDHAF4 | Succinate dehydrogenase complex assembly factor 4 | SEQ ID NO: 11755 |
| SDHB | Succinate dehydrogenase complex, subunit B, iron sulfur (Ip) | SEQ ID NOS: 11756-11758 |
| SDHD | Succinate dehydrogenase complex, subunit D, integral membrane protein | SEQ ID NOS: 11759-11768 |
| SEC14L3 | SEC14-like lipid binding 3 | SEQ ID NOS: 11769-11775 |
| SEC16A | SEC16 homolog A, endoplasmic reticulum export factor | SEQ ID NOS: 11776-11782 |
| SEC16B | SEC16 homolog B, endoplasmic reticulum export factor | SEQ ID NOS: 11783-11786 |
| SEC22C | SEC22 homolog C, vesicle trafficking protein | SEQ ID NOS: 11787-11799 |
| SEC31A | SEC31 homolog A, COPII coat complex component | SEQ ID NOS: 11800-11829 |
| SECISBP2 | SECIS binding protein 2 | SEQ ID NOS: 11830-11834 |
| SECTM1 | Secreted and transmembrane 1 | SEQ ID NOS: 11835-11842 |
| SEL1L | Sel-1 suppressor of lin-12-like (C. elegans) | SEQ ID NOS: 11843-11845 |
| SEPT15 | 15 kDa selenoprotein | SEQ ID NOS: 11846-11852 |
| SELM | Selenoprotein M | SEQ ID NOS: 11853-11855 |
| SEPN1 | Selenoprotein N, 1 | SEQ ID NOS: 11856-11859 |
| SELO | Selenoprotein O | SEQ ID NOS: 11860-11861 |
| SEPP1 | Selenoprotein P, plasma, 1 | SEQ ID NOS: 11862-11867 |
| SEMA3A | Sema domain, immunoglobulin domain (Ig), short basic domain, secreted, (semaphorin) 3A | SEQ ID NOS: 11868-11872 |
| SEMA3B | Sema domain, immunoglobulin domain (Ig), short basic domain, secreted, (semaphorin) 3B | SEQ ID NOS: 11873-11879 |
| SEMA3C | Sema domain, immunoglobulin domain (Ig), short basic domain, secreted, (semaphorin) 3C | SEQ ID NOS: 11880-11884 |
| SEMA3E | Sema domain, immunoglobulin domain (Ig), short basic domain, secreted, (semaphorin) 3E | SEQ ID NOS: 11885-11889 |
| SEMA3F | Sema domain, immunoglobulin domain (Ig), short basic domain, secreted, (semaphorin) 3F | SEQ ID NOS: 11890-11896 |
| SEMA3G | Sema domain, immunoglobulin domain (Ig), short basic domain, secreted, (semaphorin) 3G | SEQ ID NOS: 11897-11899 |
| SEMA4A | Sema domain, immunoglobulin domain (Ig), transmembrane domain (TM) and short cytoplasmic domain, (semaphorin) 4A | SEQ ID NOS: 11900-11908 |
| SEMA4B | Sema domain, immunoglobulin domain (Ig), transmembrane domain (TM) and short cytoplasmic domain, (semaphorin) 4B | SEQ ID NOS: 11909-11919 |
| SEMA4C | Sema domain, immunoglobulin domain (Ig), transmembrane domain (TM) and short cytoplasmic domain, (semaphorin) 4C | SEQ ID NOS: 11920-11922 |
| SEMA4D | Sema domain, immunoglobulin domain (Ig), transmembrane domain (TM) and short cytoplasmic domain, (semaphorin) 4D | SEQ ID NOS: 11923-11936 |
| SEMA4F | Sema domain, immunoglobulin domain (Ig), transmembrane domain (TM) and short cytoplasmic domain, (semaphorin) 4F | SEQ ID NOS: 11937-11945 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| SEMA4G | Sema domain, immunoglobulin domain (Ig), transmembrane domain (TM) and short cytoplasmic domain, (semaphorin) 4G | SEQ ID NOS: 11946-11953 |
| SEMA5A | Sema domain, seven thrombospondin repeats (type 1 and type 1-like), transmembrane domain (TM) and short cytoplasmic domain, (semaphorin) 5A | SEQ ID NOS: 11954-11955 |
| SEMA6A | Sema domain, transmembrane domain (TM), and cytoplasmic domain, (semaphorin) 6A | SEQ ID NOS: 11956-11963 |
| SEMA6C | Sema domain, transmembrane domain (TM), and cytoplasmic domain, (semaphorin) 6C | SEQ ID NOS: 11964-11969 |
| SEMA6D | Sema domain, transmembrane domain (TM), and cytoplasmic domain, (semaphorin) 6D | SEQ ID NOS: 11970-11983 |
| SEMG1 | Semenogelin I | SEQ ID NO: 11984 |
| SEMG2 | Semenogelin II | SEQ ID NO: 11985 |
| SEPT9 | Septin 9 | SEQ ID NOS: 11986-12022 |
| SERPINA1 | Serpin peptidase inhibitor, clade A (alpha-1 antiproteinase, antitrypsin), member 1 | SEQ ID NOS: 12023-12039 |
| SERPINA10 | Setpin peptidase inhibitor, clade A (alpha-1 antiprotcinasc, antitrypsin), member 10 | SEQ ID NOS: 12040-12043 |
| SERPINA11 | Serpin peptidase inhibitor, clade A (alpha-1 anti proteinase, antitrypsin), member 11 | SEQ ID NO: 12044 |
| SERPINA12 | Serpin peptidase inhibitor, clade A (alpha-1 antiproteinase, antitrypsin), member 12 | SEQ ID NOS: 12045-12046 |
| SERPINA3 | Serpin peptidase inhibitor, clade A (alpha-1 antiproteinase, antitrypsin), member 3 | SEQ ID NOS: 12047-12053 |
| SERPINA4 | Serpin peptidase inhibitor, clade A (alpha-1 antiproteinase, antitrypsin), member 4 | SEQ ID NOS: 12054-12056 |
| SERPINA5 | Serpin peptidase inhibitor, clade A (alpha-1 antiproteinase, antitrypsin), member 5 | SEQ ID NOS: 12057-12068 |
| SERPINA6 | Serpin peptidase inhibitor, clade A (alpha-1 antiproteinase, antitrypsin), member 6 | SEQ ID NOS: 12069-12071 |
| SERPINA7 | Setpin peptidase inhibitor, clade A (alpha-1 antiproteinase, antitrypsin), member 7 | SEQ ID NOS: 12072-12073 |
| SERPINA9 | Serpin peptidase inhibitor, clade A (alpha-1 antiproteinase, antitrypsin), member 9 | SEQ ID NOS: 12074-12080 |
| SERPINB2 | Serpin peptidase inhibitor, clade B (ovalbumin), member 2 | SEQ ID NOS: 12081-12085 |
| SERPINC1 | Serpin peptidase inhibitor, clade C (antithrombin), member 1 | SEQ ID NOS: 12086-12087 |
| SERPIND1 | Serpin peptidase inhibitor, clade D (heparin cofactor), member 1 | SEQ ID NOS: 12088-12089 |
| SERPINE1 | Serpin peptidase inhibitor, clade E (nexin, plasminogen activator inhibitor type 1), member 1 | SEQ ID NO: 12090 |
| SERPINE2 | Serpin peptidase inhibitor, clade E (nexin, plasminogen activator inhibitor type 1), member 2 | SEQ ID NOS: 12091-12097 |
| SERPINE3 | Serpin peptidase inhibitor, clade E (nexin, plasminogen activator inhibitor type 1), member 3 | SEQ ID NOS: 12098-12101 |
| SERPINF1 | Serpin peptidase inhibitor, clade F (alpha-2 antiplasmin, pigment epithelium derived factor), member 1 | SEQ ID NOS: 12102-12110 |
| SERPINF2 | Serpin peptidase inhibitor, clade F (alpha-2 antiplasmin, pigment epithelium derived factor), member 2 | SEQ ID NOS: 12111-12115 |
| SERPING1 | Serpin peptidase inhibitor, clade G (C1 inhibitor), member 1 | SEQ ID NOS: 12116-12126 |
| SERPINH1 | Serpin peptidase inhibitor, clade H (heat shock protein 47), member 1, (collagen binding protein 1) | SEQ ID NOS: 12127-12141 |
| SERPINI1 | Serpin peptidase inhibitor, clade I (neuroserpin), member 1 | SEQ ID NOS: 12142-12146 |
| SERPINI2 | Serpin peptidase inhibitor, clade I (panepin), member 2 | SEQ ID NOS: 12147-12153 |
| SEZ6L2 | Seizure related 6 homolog (mouse)-like 2 | SEQ ID NOS: 12154-12160 |
| SFRP1 | Secreted frizzled-related protein 1 | SEQ ID NOS: 12161-12162 |
| SFRP2 | Secreted frizzled-related protein 2 | SEQ ID NO: 12163 |
| SFRP4 | Secreted frizzled-related protein 4 | SEQ ID NOS: 12164-12165 |
| SFRP5 | Secreted frizzled-related protein 5 | SEQ ID NO: 12166 |
| SFTA2 | Surfactant associated 2 | SEQ ID NOS: 12167-12168 |
| SFTPA1 | Surfactant protein A1 | SEQ ID NOS: 12169-12173 |
| SFTPA2 | Surfactant protein A2 | SEQ ID NOS: 12174-12178 |
| SFTPB | Surfactant protein B | SEQ ID NOS: 12179-12183 |
| SFTPD | Surfactant protein D | SEQ ID NOS: 12184-12185 |
| SFXN5 | Sideroflexin 5 | SEQ ID NOS: 12186-12190 |
| SGCA | Sarcoglycan, alpha (50 kDa dystrophin-associated glycoprotein) | SEQ ID NOS: 12191-12198 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| SGSH | N-sulfoglucosamine sulfohydrolase | SEQ ID NOS: 12199-12207 |
| SH3RF3 | SH3 domain containing ring finger 3 | SEQ ID NO: 12208 |
| SHBG | Sex hormone-binding globulin | SEQ ID NOS: 12209-12227 |
| SHE | Src homology 2 domain containing E | SEQ ID NOS: 12228-12230 |
| SHH | Sonic hedgehog | SEQ ID NOS: 12231-12234 |
| SHKBP1 | SH3KBP1 binding protein 1 | SEQ ID NOS: 12235-12250 |
| SIAE | Sialic acid acetylesterase | SEQ ID NOS: 12251-12253 |
| SIDT2 | SID1 transmembrane family, member 2 | SEQ ID NOS: 12254-12263 |
| SIGLEC10 | Sialic acid binding Ig-like lectin 10 | SEQ ID NOS: 12264-12272 |
| SIGLEC6 | Sialic acid binding Ig-like lectin 6 | SEQ ID NOS: 12273-12278 |
| SIGLEC7 | Sialic acid binding Ig-like lectin 7 | SEQ ID NOS: 12279-12283 |
| SIGLECL1 | SIGLEC family like 1 | SEQ ID NOS: 12284-12289 |
| SIGMAR1 | Sigma non-opioid intracellular receptor 1 | SEQ ID NOS: 12290-12293 |
| SIL1 | SIL1 nucleotide exchange factor | SEQ ID NOS: 12294-12302 |
| SIRPB1 | Signal-regulatory protein beta 1 | SEQ ID NOS: 12303-12315 |
| SIRPD | Signal-regulatory protein delta | SEQ ID NOS: 12316-12318 |
| SLAMF1 | Signaling lymphocytic activation molecule family member 1 | SEQ ID NOS: 12319-12321 |
| SLAMF7 | SLAM family member 7 | SEQ ID NOS: 12322-12330 |
| SLC10A3 | Solute carrier family 10, member 3 | SEQ ID NOS: 12331-12335 |
| SLC15A3 | Solute carrier family 15 (oligopeptide transporter), member 3 | SEQ ID NOS: 12336-12341 |
| SLC25A14 | Solute carrier family 25 (mitochondrial carrier, brain), member 14 | SEQ ID NOS: 12342-12348 |
| SLC25A25 | Solute carrier family 25 (mitochondrial carrier; phosphate carrier), member 25 | SEQ ID NOS: 12349-12355 |
| SLC2A5 | Solute carrier family 2 (facilitated glucose/fructose transporter), member 5 | SEQ ID NOS: 12356-12364 |
| SLC35E3 | Solute carrier family 35, member E3 | SEQ ID NOS: 12365-12366 |
| SLC39A10 | Solute carrier family 39 (zinc transporter), member 10 | SEQ ID NOS: 12367-12373 |
| SLC39A14 | Solute carrier family 39 (zinc transporter), member 14 | SEQ ID NOS: 12374-12384 |
| SLC39A4 | Solute carrier family 39 (zinc transporter), member 4 | SEQ ID NOS: 12385-12387 |
| SLC39A5 | Solute carrier family 39 (zinc transporter), member 5 | SEQ ID NOS: 12388-12394 |
| SLC3A1 | Solute carrier family 3 (amino acid transporter heavy chain), member 1 | SEQ ID NOS: 12395-12404 |
| SLC51A | Solute carrier family 51, alpha subunit | SEQ ID NOS: 12405-12409 |
| SLC52A2 | Solute carrier family 52 (riboflavin transporter), member 2 | SEQ ID NOS: 12410-12420 |
| SLC5A6 | Solute carrier family 5 (sodium/multivitamin and iodide cotransporter), member 6 | SEQ ID NOS: 12421-12431 |
| SLC6A9 | Solute carrier family 6 (neurotransmitter transporter, glycine), member 9 | SEQ ID NOS: 12432-12439 |
| SLC8A1 | Solute carrier family 8 (sodium/calcium exchanger), member 1 | SEQ ID NOS: 12440-12451 |
| SLC8B1 | Solute carrier family 8 (sodium/lithium/calcium exchanger), member B1 | SEQ ID NOS: 12452-12462 |
| SLC9A6 | Solute carrier family 9, subfamily A (NHE6, cation proton antiporter 6), member 6 | SEQ ID NOS: 12463-12474 |
| SLCO1A2 | Solute carrier organic anion transporter family, member 1A2 | SEQ ID NOS: 12475-12488 |
| SLIT1 | Slit guidance ligand 1 | SEQ ID NOS: 12489-12492 |
| SLIT2 | Slit guidance ligand 2 | SEQ ID NOS: 12493-12501 |
| SLIT3 | Slit guidance ligand 3 | SEQ ID NOS: 12502-12504 |
| SLITRK3 | SLIT and NTRK-like family, member 3 | SEQ ID NOS: 12505-12507 |
| SLPI | Secretory leukocyte peptidase inhibitor | SEQ ID NO: 12508 |
| SLTM | SAFB-like, transcription modulator | SEQ ID NOS: 12509-12522 |
| SLURP1 | Secreted LY6/PLAUR domain containing 1 | SEQ ID NO: 12523 |
| SMARCA2 | SWI/SNF related, matrix associated, actin dependent regulator of chromatin, subfamily a, member 2 | SEQ ID NOS: 12524-12571 |
| SMG6 | SMG6 nonsense mediated mRNA decay factor | SEQ ID NOS: 12572-12583 |
| SMIM7 | Small integral membrane protein 7 | SEQ ID NOS: 12584-12600 |
| SMOC1 | SPARC related modular calcium binding 1 | SEQ ID NOS: 12601-12602 |
| SMOC2 | SPARC related modular calcium binding 2 | SEQ ID NOS: 12603-12607 |
| SMPDL3A | Sphingomyelin phosphodiesterase, acid-like 3A | SEQ ID NOS: 12608-12609 |
| SMPDL3B | Sphingomyelin phosphodiesterase, acid-like 3B | SEQ ID NOS: 12610-12614 |
| SMR3A | Submaxillary gland androgen regulated protein 3A | SEQ ID NO: 12615 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| SMR3B | Submaxillary gland androgen regulated protein 3B | SEQ ID NOS: 12616-12618 |
| SNED1 | Sushi, nidogen and EGF-like domains 1 | SEQ ID NOS: 12619-12625 |
| SNTB1 | Syntrophin, beta 1 (dystrophin-associated protein A1, 59 kDa, basic component 1) | SEQ ID NOS: 12626-12628 |
| SNTB2 | Syntrophin, beta 2 (dystrophin-associated protein A1, 59 kDa, basic component 2) | SEQ ID NOS: 12629-12633 |
| SNX14 | Sorting nexin 14 | SEQ ID NOS: 12634-12645 |
| SOD3 | Superoxide dismutase 3, extracellular | SEQ ID NOS: 12646-12647 |
| SOST | Sclerostin | SEQ ID NO: 12648 |
| SOSTDC1 | Sclerostin domain containing 1 | SEQ ID NOS: 12649-12650 |
| SOWAHA | Sosondowah ankyrin repeat domain family member A | SEQ ID NO: 12651 |
| SPACA3 | Sperm acrosome associated 3 | SEQ ID NOS: 12652-12654 |
| SPACA4 | Sperm acrosome associated 4 | SEQ ID NO: 12655 |
| SPACA5 | Sperm acrosome associated 5 | SEQ ID NOS: 12656-12657 |
| SPACA5B | Sperm acrosome associated 5B | SEQ ID NO: 12658 |
| SPACA7 | Sperm acrosome associated 7 | SEQ ID NOS: 12659-12662 |
| SPAG11A | Sperm associated antigen 11A | SEQ ID NOS: 12663-12671 |
| SPAG11B | Sperm associated antigen 11B | SEQ ID NOS: 12672-12680 |
| SPARC | Secreted protein, acidic, cystcinc-rich (osteonectin) | SEQ ID NOS: 12681-12685 |
| SPARCL1 | SPARC-like 1 (hevin) | SEQ ID NOS: 12686-12695 |
| SPATA20 | Spermatogenesis associated 20 | SEQ ID NOS: 12696-12709 |
| SPESP1 | Sperm equatorial segment protein 1 | SEQ ID NO: 12710 |
| SPINK1 | Serine peptidase inhibitor, Kazal type 1 | SEQ ID NOS: 12711-12712 |
| SPINK13 | Serine peptidase inhibitor, Kazal type 13 (putative) | SEQ ID NOS: 12713-12715 |
| SPINK14 | Serine peptidase inhibitor, Kazal type 14 (putative) | SEQ ID NOS: 12716-12717 |
| SPINK2 | Serine peptidase inhibitor, Kazal type 2 (acrosin-trypsin inhibitor) | SEQ ID NOS: 12718-12723 |
| SPINK4 | Serine peptidase inhibitor, Kazal type 4 | SEQ ID NOS: 12724-12725 |
| SPINK5 | Serine peptidase inhibitor, Kazal type 5 | SEQ ID NOS: 12726-12731 |
| SPINK6 | Serine peptidase inhibitor, Kazal type 6 | SEQ ID NOS: 12732-12734 |
| SPINK7 | Serine peptidase inhibitor, Kazal type 7 (putative) | SEQ ID NOS: 12735-12736 |
| SPINK8 | Serine peptidase inhibitor, Kazal type 8 (putative) | SEQ ID NO: 12737 |
| SPINK9 | Serine peptidase inhibitor, Kazal type 9 | SEQ ID NOS: 12738-12739 |
| SPINT1 | Serine peptidase inhibitor, Kunitz type 1 | SEQ ID NOS: 12740-12747 |
| SPINT2 | Serine peptidase inhibitor, Kunitz type, 2 | SEQ ID NOS: 12748-12755 |
| SPINT3 | Serine peptidase inhibitor, Kunitz type, 3 | SEQ ID NO: 12756 |
| SPINT4 | Serine peptidase inhibitor, Kunitz type 4 | SEQ ID NO: 12757 |
| SPOCK1 | Sparc/osteonectin, cwcv and kazal-like domains proteoglycan (testican) 1 | SEQ ID NOS: 12758-12761 |
| SPOCK2 | Sparc/osteonectin, cwcv and kazal-like domains proteoglycan (testican) 2 | SEQ ID NOS: 12762-12765 |
| SPOCK3 | Sparc/osteonectin, cwcv and kazal-like domains proteoglycan (testican) 3 | SEQ ID NOS: 12766-12791 |
| SPON1 | Spondin 1, extracellular matrix protein | SEQ ID NO: 12792 |
| SPON2 | Spondin 2, extracellular matrix protein | SEQ ID NOS: 12793-12802 |
| SPP1 | Secreted phosphoprotein 1 | SEQ ID NOS: 12803-12807 |
| SPP2 | Secreted phosphoprotein 2, 24 kDa | SEQ ID NOS: 12808-12810 |
| SPRN | Shadow of prion protein homolog (zebrafish) | SEQ ID NO: 12811 |
| SPRYD3 | SPRY domain containing 3 | SEQ ID NOS: 12812-12815 |
| SPRYD4 | SPRY domain containing 4 | SEQ ID NO: 12816 |
| SPTY2D1-AS1 | SPTY2D1 antisense RNA 1 | SEQ ID NOS: 12817-12822 |
| SPX | Spexin hormone | SEQ ID NOS: 12823-12824 |
| SRGN | Serglycin | SEQ ID NO: 12825 |
| SRL | Sarcalumenin | SEQ ID NOS: 12826-12828 |
| SRP14 | Signal recognition particle 14 kDa (homologous Alu RNA binding protein) | SEQ ID NOS: 12829-12832 |
| SRPX | Sushi-repeat containing protein, X-linked | SEQ ID NOS: 12833-12836 |
| SRPX2 | Sushi-repeat containing protein, X-linked 2 | SEQ ID NOS: 12837-12840 |
| SSC4D | Scavenger receptor cysteine rich family, 4 domains | SEQ ID NO: 12841 |
| SSC5D | Scavenger receptor cysteine rich family, 5 domains | SEQ ID NOS: 12842-12845 |
| SSPO | SCO-spondin | SEQ ID NO: 12846 |
| SSR2 | Signal sequence receptor, beta (translocon-associated protein beta) | SEQ ID NOS: 12847-12856 |
| SST | Somatostatin | SEQ ID NO: 12857 |
| ST3GAL1 | ST3 beta-galactoside alpha-2,3-sialyltransferase 1 | SEQ ID NOS: 12858-12865 |
| ST3GAL4 | ST3 beta-galactoside alpha-2,3-sialyltransferase 4 | SEQ ID NOS: 12866-12881 |
| ST6GAL1 | ST6 beta-galactosamide alpha-2,6-sialyltranferase 1 | SEQ ID NOS: 12882-12897 |
| ST6GALNAC2 | ST6 (alpha-N-acetyl-neuraminyl-2,3-beta-galactosvl-1,3)-N-acetylgalactosaminide alpha-2,6-sialyltransferase 2 | SEQ ID NOS: 12898-12902 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| ST6GALNAC5 | ST6 (alpha-N-acetyl-neuraminyl-2,3-beta-galactosyl-1,3)-N-acetylgalactosaminide alpha-2,6-sialyltransferase 5 | SEQ ID NOS: 12903-12904 |
| ST6GALNAC6 | ST6 (alpha-N-acetyl-neuraminyl-2,3-beta-galactosyl-1,3)-N-acelylgalaclosaminide alpha-2,6-sialyltransferase 6 | SEQ ID NOS: 12905-12912 |
| ST8SIA2 | ST8 alpha-N-acetyl-neuraminide alpha-2,8-sialyltransferase 2 | SEQ ID NOS: 12913-12915 |
| ST8SIA4 | ST8 alpha-N-acetyl-neuraminide alpha-2,8-sialyltransferase 4 | SEQ ID NOS: 12916-12918 |
| ST8SIA6 | ST8 alpha-N-acetyl-neuraminide alpha-2,8-sialyltransferase 6 | SEQ ID NOS: 12919-12920 |
| STARD7 | StAR-related lipid transfer (START) domain containing 7 | SEQ ID NOS: 12921-12922 |
| STATH | Statherin | SEQ ID NOS: 12923-12925 |
| STC1 | Stanniocalcin 1 | SEQ ID NOS: 12926-12927 |
| STC2 | Stanniocalcin 2 | SEQ ID NOS: 12928-12930 |
| STMND1 | Stathmin domain containing 1 | SEQ ID NOS: 12931-12932 |
| C7orf73 | Chromosome 7 open reading frame 73 | SEQ ID NOS: 12933-12934 |
| STOML2 | Stomatin (EPB72)-like 2 | SEQ ID NOS: 12935-12938 |
| STOX1 | Storkhead box 1 | SEQ ID NOS: 12939-12943 |
| STRC | Stereocilin | SEQ ID NOS: 12944-12949 |
| SUCLG1 | Succinate-CoA ligase, alpha subunit | SEQ ID NOS: 12950-12951 |
| SUDS3 | SDS3 homolog, SIN3A corepressor complex component | SEQ ID NO: 12952 |
| SULF1 | Sulfatase 1 | SEQ ID NOS: 12953-12963 |
| SULF2 | Sulfatase 2 | SEQ ID NOS: 12964-12968 |
| SUMF1 | Sulfatase modifying factor 1 | SEQ ID NOS: 12969-12973 |
| SUMF2 | Sulfatase modifying factor 2 | SEQ ID NOS: 12974-12987 |
| SUSD1 | Sushi domain containing 1 | SEQ ID NOS: 12988-12993 |
| SUSD5 | Sushi domain containing 5 | SEQ ID NOS: 12994-12995 |
| SVEP1 | Sushi, von Willebrand factor type A, EGF and pentraxin domain containing 1 | SEQ ID NOS: 12996-12998 |
| SWSAP1 | SWIM-type zinc finger 7 associated protein 1 | SEQ ID NO: 12999 |
| SYAP1 | Synapse associated protein 1 | SEQ ID NO: 13000 |
| SYCN | Syncoilin | SEQ ID NO: 13001 |
| TAC1 | Tachykinin, precursor 1 | SEQ ID NOS: 13002-13004 |
| TAC3 | Tachykinin 3 | SEQ ID NOS: 13005-13014 |
| TAC4 | Tachykinin 4 (hemokinin) | SEQ ID NOS: 13015-13020 |
| TAGLN2 | Transgelin 2 | SEQ ID NOS: 13021-13024 |
| TAPBP | TAP binding protein (tapasin) | SEQ ID NOS: 13025-13030 |
| TAPBPL | TAP binding protein-like | SEQ ID NOS: 13031-13032 |
| TBL2 | Transducin (beta)-like 2 | SEQ ID NOS: 13033-13045 |
| TBX10 | T-box 10 | SEQ ID NO: 13046 |
| TCF12 | Transcription factor 12 | SEQ ID NOS: 13047-13060 |
| TCN1 | Transcobalamin I (vitamin B12, binding protein, R binder family) | SEQ ID NO: 13061 |
| TCN2 | Transcobalamin II | SEQ ID NOS: 13062-13065 |
| TCTN1 | Tectonic family member 1 | SEQ ID NOS: 13066-13084 |
| TCTN3 | Tectonic family member 3 | SEQ ID NOS: 13085-13089 |
| TDP2 | Tyrosyl-DNA phosphodiesterase 2 | SEQ ID NOS: 13090-13091 |
| C14orf80 | Chromosome 14 open reading frame 80 | SEQ ID NOS: 13092-13105 |
| TEK | TEK tyrosine kinase, endothelial | SEQ ID NOS: 13106-13110 |
| TEPP | Testis, prostate and placenta expressed | SEQ ID NOS: 13111-13112 |
| TEX101 | Testis expressed 101 | SEQ ID NOS: 13113-13114 |
| TEX264 | Testis expressed 264 | SEQ ID NOS: 13115-13126 |
| C1orf234 | Chromosome 1 open reading frame 234 | SEQ ID NOS: 13127-13129 |
| TF | Transferrin | SEQ ID NOS: 13130-13136 |
| TFAM | Transcription factor A, mitochondrial | SEQ ID NOS: 13137-13139 |
| TFF1 | Trefoil factor 1 | SEQ ID NO: 13140 |
| TFF2 | Trefoil factor 2 | SEQ ID NO: 13141 |
| TFF3 | Trefoil factor 3 (intestinal) | SEQ ID NOS: 13142-13144 |
| TFPI | Tissue factor pathway inhibitor (lipoprotein-associated coagulation inhibitor) | SEQ ID NOS: 13145-13154 |
| TFPI2 | Tissue factor pathway inhibitor 2 | SEQ ID NOS: 13155-13156 |
| TG | Thyroglobulin | SEQ ID NOS: 13157-13166 |
| TGFB1 | Transforming growth factor, beta 1 | SEQ ID NOS: 13167-13168 |
| TGFB2 | Transforming growth factor, beta 2 | SEQ ID NOS: 13169-13170 |
| TGFB3 | Transforming growth factor, beta 3 | SEQ ID NOS: 13171-13172 |
| TGFBI | Transforming growth factor, beta-induced, 68 kDa | SEQ ID NOS: 13173-13180 |
| TGFBR1 | Transforming growth factor, beta receptor III | SEQ ID NOS: 13181-13190 |
| TGFBR3 | Transforming growth factor, beta receptor III | SEQ ID NOS: 13191-13197 |
| THBS1 | Thrombospondin 1 | SEQ ED NOS: 13198-13199 |
| THBS2 | Thrombospondin 2 | SEQ ID NOS: 13200-13202 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| THBS3 | Thrombospondin 3 | SEQ ID NOS: 13203-13207 |
| THBS4 | Thrombospondin 4 | SEQ ID NOS: 13208-13209 |
| THOC3 | THO complex 3 | SEQ ID NOS: 13210-13219 |
| THPO | Thrombopoietin | SEQ ID NOS: 13220-13225 |
| THSD4 | Thrombospondin, type I, domain containing 4 | SEQ ID NOS: 13226-13229 |
| THY1 | Thy-1 cell surface antigen | SEQ ID NOS: 13230-13235 |
| TIE1 | Tyrosine kinase with immunoglobulin-like and EGF-like domains 1 | SEQ ID NOS: 13236-13237 |
| TIMMDC1 | Translocase of inner mitochondrial membrane domain containing 1 | SEQ ID NOS: 13238-13245 |
| TIMP1 | TIMP metallopeptidase inhibitor 1 | SEQ ID NOS: 13246-13250 |
| TIMP2 | TIMP metallopeptidase inhibitor 2 | SEQ ID NOS: 13251-13255 |
| TIMP3 | TIMP metallopeptidase inhibitor 3 | SEQ ID NO: 13256 |
| TIMP4 | TIMP metallopeptidase inhibitor 4 | SEQ ID NO: 13257 |
| TINAGL1 | Tubulointerstitial nephritis antigen-like 1 | SEQ ID NOS: 13258-13260 |
| TINF2 | TERF1 (TRF1)-interacting nuclear factor 2 | SEQ ID NOS: 13261-13270 |
| TLL2 | Tolloid-like 2 | SEQ ID NO: 13271 |
| TLR1 | Toll-like receptor 1 | SEQ ID NOS: 13272-13277 |
| TLR3 | Toll-like receptor 3 | SEQ ID NOS: 13278-13280 |
| TM2D2 | TM2 domain containing 2 | SEQ ID NOS: 13281-13286 |
| TM2D3 | TM2 domain containing 3 | SEQ ID NOS: 13287-13294 |
| TM7SF3 | Transmembrane 7 superfamily member 3 | SEQ ID NOS: 13295-13309 |
| TM9SF1 | Transmembrane 9 superfamily member 1 | SEQ ID NOS: 13310-13320 |
| TMCO6 | Transmembrane and coiled-coil domains 6 | SEQ ID NOS: 13321-13328 |
| TMED1 | Transmembrane p24 trafficking protein 1 | SEQ ID NOS: 13329-13335 |
| TMED2 | Transmembrane p24 trafficking protein 2 | SEQ ID NOS: 13336-13338 |
| TMED3 | Transmembrane p24 trafficking protein 3 | SEQ ID NOS: 13339-13342 |
| TMED4 | Transmembrane p24 trafficking protein 4 | SEQ ID NOS: 13343-13345 |
| TMED5 | Transmembrane p24 trafficking protein 5 | SEQ ID NOS: 13346-13349 |
| TMED7 | Transmembrane p24 trafficking protein 7 | SEQ ID NOS: 13350-13351 |
| TMED7-TICAM2 | TMED7-TICAM2 readthrough | SEQ ID NOS: 13352-13353 |
| TMEM108 | Transmembrane protein 108 | SEQ ID NOS: 13354-13362 |
| TMEM116 | Transmembrane protein 116 | SEQ ID NOS: 13363-13374 |
| TMEM119 | Transmembrane protein 119 | SEQ ID NOS: 13375-13378 |
| TMEM155 | Transmembrane protein 155 | SEQ ID NOS: 13379-13382 |
| TMEM168 | Transmembrane protein 168 | SEQ ID NOS: 13383-13388 |
| TMEM178A | Transmembrane protein 178A | SEQ ID NOS: 13389-13390 |
| TMEM179 | Transmembrane protein 179 | SEQ ID NOS: 13391-13396 |
| TMEM196 | Transmembrane protein 196 | SEQ ID NOS: 13397-13401 |
| TMEM199 | Transmembrane protein 199 | SEQ ID NOS: 13402-13405 |
| TMEM205 | Transmembrane protein 205 | SEQ ID NOS: 13406-13419 |
| TMEM213 | Transmembrane protein 213 | SEQ ID NOS: 13420-13423 |
| TMEM25 | Transmembrane protein 25 | SEQ ID NOS: 13424-13440 |
| TMEM30C | Transmembrane protein 30C | SEQ ID NO: 13441 |
| TMEM38B | Transmembrane protein 38B | SEQ ID NOS: 13442-13446 |
| TMEM44 | Transmembrane protein 44 | SEQ ID NOS: 13447-13456 |
| TMEM52 | Transmembrane protein 52 | SEQ ID NOS: 13457-13461 |
| TMEM52B | Transmembrane protein 52B | SEQ ID NOS: 13462-13464 |
| TMEM59 | Transmembrane protein 59 | SEQ ID NOS: 13465-13472 |
| TMEM67 | Transmembrane protein 67 | SEQ ID NOS: 13473-13484 |
| TMEM70 | Transmembrane protein 70 | SEQ ID NOS: 13485-13487 |
| TMEM87A | Transmembrane protein 87A | SEQ ID NOS: 13488-13497 |
| TMEM94 | Transmembrane protein 94 | SEQ ID NOS: 13498-13513 |
| TMEM95 | Transmembrane protein 95 | SEQ ID NOS: 13514-13516 |
| TMIGD1 | Transmembrane and immunoglobulin domain containing 1 | SEQ ID NOS: 13517-13518 |
| TMPRSS12 | Transmembrane (C-terminal) protease, serine 12 | SEQ ID NOS: 13519-13520 |
| TMPRSS5 | Transmembrane protease, serine 5 | SEQ ID NOS: 13521-13532 |
| TMUB1 | Transmembrane and ubiquitin-like domain containing 1 | SEQ ID NOS: 13533-13539 |
| TMX2 | Thioredoxin-related transmembrane protein 2 | SEQ ID NOS: 13540-13547 |
| TMX3 | Thioredoxin-related transmembrane protein 3 | SEQ ID NOS: 13548-13555 |
| TNC | Tenascin C | SEQ ID NOS: 13556-13564 |
| TNFAIP6 | Tumor necrosis factor, alpha-induced protein 6 | SEQ ID NO: 13565 |
| TNFRSF11A | Tumor necrosis factor receptor superfamily, member 11a, NFKB activator | SEQ ID NOS: 13566-13570 |
| TNFRSF11B | Tumor necrosis factor receptor superfamily, member 11b | SEQ ID NOS: 13571-13572 |
| TNFRSF12A | Tumor necrosis factor receptor superfamily, member 12A | SEQ ID NOS: 13573-13578 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| TNFRSF14 | Tumor necrosis factor receptor superfamily, member 14 | SEQ ID NOS: 13579-13585 |
| TNFRSF18 | Tumor necrosis factor receptor superfamily, member 18 | SEQ ID NOS: 13586-13589 |
| TNFRSF1A | Tumor necrosis factor receptor superfamily, member 1A | SEQ ID NOS: 13590-13598 |
| TNFRSF1B | Tumor necrosis factor receptor superfamily, member 1B | SEQ ID NOS: 13599-13600 |
| TNFRSF25 | Tumor necrosis factor receptor superfamily, member 25 | SEQ ID NOS: 13601-13612 |
| TNFRSF6B | Tumor necrosis factor receptor superfamily, member 6b, decoy | SEQ ID NO: 13613 |
| TNFSF11 | Tumor necrosis factor (ligand) superfamily, member 11 | SEQ ID NOS: 13614-13618 |
| TNFSF12 | Tumor necrosis factor (ligand) superfamily, member 12, | SEQ ID NOS: 13619-13620 |
| TNFSF12-TNFSF13 | TNFSF12-TNFSF13 readthrough | SEQ ID NO: 13621 |
| TNFSF15 | Tumor necrosis factor (ligand) superfamily, member 15 | SEQ ID NOS: 13622-13623 |
| TNN | Tenascin N | SEQ ID NOS: 13624-13626 |
| TNR | Tenascin R | SEQ ID NOS: 13627-13629 |
| TNXB | Tenascin XB | SEQ ID NOS: 13630-13636 |
| FAM179B | Family with sequence similarity 179, member B | SEQ ID NOS: 13637-13642 |
| TOMM7 | Translocase of outer mitochondrial membrane 7 homolog (yeast) | SEQ ID NOS: 13643-13646 |
| TOP1MT | Topoisomerase (DMA) I, mitochondrial | SEQ ID NOS: 13647-13661 |
| TOR1A | Torsin family 1, member A (torsin A) | SEQ ID NO: 13662 |
| TOR1B | Torsin family 1, member B (torsin B) | SEQ ID NOS: 13663-13664 |
| TOR2A | Torsin family 2, member A | SEQ ID NOS: 13665-13671 |
| TOR3A | Torsin family 3, member A | SEQ ID NOS: 13672-13676 |
| TPD52 | Tumor protein D52 | SEQ ID NOS: 13677-13689 |
| TPO | Thyroid peroxidase | SEQ ID NOS: 13690-13700 |
| TPP1 | Tripeptidyl peptidase I | SEQ ID NOS: 13701-13718 |
| TPSAB1 | Tryptase alpha/beta 1 | SEQ ID NOS: 13719-13721 |
| TPSB2 | Tryptase beta 2 (gene/pseudogene) | SEQ ID NOS: 13722-13724 |
| TPSD1 | Tryptase delta 1 | SEQ ID NOS: 13725-13726 |
| TPST1 | Tyrosylprotein sulfotransferase 1 | SEQ ID NOS: 13727-13729 |
| TPST2 | Tyrosylprotein sulfotransferase 2 | SEQ ID NOS: 13730-13738 |
| TRABD2A | TraB domain containing 2A | SEQ ID NOS: 13739-13741 |
| TRABD2B | TraB domain containing 2B | SEQ ID NO: 13742 |
| TREH | Trehalase (brush-border membrane glycoprotein) | SEQ ID NOS: 13743-13745 |
| TREM1 | Triggering receptor expressed on myeloid cells 1 | SEQ ID NOS: 13746-13749 |
| TREM2 | Triggering receptor expressed on myeloid cells 2 | SEQ ID NOS: 13750-13752 |
| TRH | Thyrotropin-releasing hormone | SEQ ID NOS: 13753-13754 |
| TRIM24 | Tripartite motif containing 24 | SEQ ID NOS: 13755-13756 |
| TRIM28 | Tripartite motif containing 28 | SEQ ID NOS: 13757-13762 |
| TRIO | Trio Rho guanine nucleotide exchange factor | SEQ ID NOS: 13763-13769 |
| TRNP1 | TMF1-regulated nuclear protein 1 | SEQ ID NOS: 13770-13771 |
| TSC22D4 | TSC22 domain family, member 4 | SEQ ID NOS: 13772-13775 |
| TSHB | Thyroid stimulating hormone, beta | SEQ ID NOS: 13776-13777 |
| TSHR | Thyroid stimulating hormone receptor | SEQ ID NOS: 13778-13785 |
| TSKU | Tsukushi, small leucine rich proteoglycan | SEQ ID NOS: 13786-13790 |
| TSLP | Thymic stromal lymphopoietin | SEQ ID NOS: 13791-13793 |
| TSPAN3 | Tetraspanin 3 | SEQ ID NOS: 13794-13799 |
| TSPAN31 | Tetraspanin 31 | SEQ ID NOS: 13800-13806 |
| TSPEAR | Thrombospondin-type laminin G domain and EAR repeats | SEQ ID NOS: 13807-13810 |
| TTC13 | Tetratricopeptide repeat domain 13 | SEQ ID NOS: 13811-13817 |
| TTC19 | Tetratricopeptide repeat domain 19 | SEQ ID NOS: 13818-13823 |
| TTC9B | Tetratricopeptide repeat domain 9B | SEQ ID NO: 13824 |
| TTLL11 | Tubulin tyrosine ligase-like family member 11 | SEQ ID NOS: 13825-13829 |
| TTR | Transthyretin | SEQ ID NOS: 13830-13832 |
| TWSG1 | Twisted gastrulation BMP signaling modulator 1 | SEQ ID NOS: 13833-13835 |
| TXNDC12 | Thioredoxin domain containing 12 (endoplasmic reticulum) | SEQ ID NOS: 13836-13838 |
| TXNDC15 | Thioredoxin domain containing 15 | SEQ ID NOS: 13839-13845 |
| TXNDC5 | Thioredoxin domain containing 5 (endoplasmic reticulum) | SEQ ID NOS: 13846-13847 |
| TXNRD2 | Thioredoxin reductase 2 | SEQ ID NOS: 13848-13860 |
| TYRP1 | Tyrosinase-related protein 1 | SEQ ID NOS: 13861-13863 |
| UBAC2 | UBA domain containing 2 | SEQ ID NOS: 13864-13868 |
| UBALD1 | UBA-like domain containing 1 | SEQ ID NOS: 13869-13877 |
| UBAP2 | Ubiquitin associated protein 2 | SEQ ID NOS: 13878-13884 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| UBXN8 | UBX domain protein 8 | SEQ ID NOS: 13885-13891 |
| UCMA | Upper zone of growth plate and cartilage matrix associated | SEQ ID NOS: 13892-13893 |
| UCN | Urocortin | SEQ ID NO: 13894 |
| UCN2 | Urocortin 2 | SEQ ID NO: 13895 |
| UCN3 | Urocortin 3 | SEQ ID NO: 13896 |
| UGGT2 | UDP-glucose glycoprotein glucosyltransferase 2 | SEQ ID NOS: 13897-13902 |
| UGT1A10 | UDP glucuronosyltransferase 1 family, polypeptide A10 | SEQ ID NOS: 13903-13904 |
| UGT2A1 | UDP glucuronosyltransferase 2 family, polypeptide A1, complex locus | SEQ ID NOS: 13905-13909 |
| UGT2B11 | UDP glucuronosyltransferase 2 family, polypeptide B11 | SEQ ID NO: 13910 |
| UGT2B28 | UDP glucuronosyltransferase 2 family, polypeptide B28 | SEQ ID NOS: 13911-13912 |
| UGT2B4 | UDP glucuronosyltransferase 2 family, polypeptide B4 | SEQ ID NOS: 13913-13916 |
| UGT2B7 | UDP glucuronosyltransferase 2 family, polypeptide B7 | SEQ ID NOS: 13917-13920 |
| UGT3A1 | UDP glycosyltransferase 3 family, polypeptide A1 | SEQ ID NOS: 13921-13926 |
| UGT3A2 | UDP glycosyltransferase 3 family, polypeptide A2 | SEQ ID NOS: 13927-13930 |
| UGT8 | UDP glycosyltransfcrasc 8 | SEQ ID NOS: 13931-13933 |
| ULBP3 | UL16 binding protein 3 | SEQ ID NOS: 13934-13935 |
| UMOD | Uromodulin | SEQ ID NOS: 13936-13947 |
| UNC5C | Unc-5 netrin receptor C | SEQ ID NOS: 13948-13952 |
| UPK3B | Uroplakin 3B | SEQ ID NOS: 13953-13955 |
| USP11 | Ubiquitin specific peptidase 11 | SEQ ID NOS: 13956-13959 |
| USP14 | Ubiquitin specific peptidase 14 (tRNA-guanine transglycosylase) | SEQ ID NOS: 13960-13966 |
| USP3 | Ubiquitin specific peptidase 3 | SEQ ID NOS: 13967-13982 |
| CIRH1A | Cirrhosis, autosomal recessive 1A (cirhin) | SEQ ID NOS: 13983-13992 |
| UTS2 | Urotensin 2 | SEQ ID NOS: 13993-13995 |
| UTS2B | Urotensin 2B | SEQ ID NOS: 13996-14001 |
| UTY | Ubiquitously transcribed tetratricopeptide repeat containing. Y-linked | SEQ ID NOS: 14002-14014 |
| UXS1 | UDP-glucuronate decarboxylase 1 | SEQ ID NOS: 14015-14022 |
| VASH1 | Vasohibin 1 | SEQ ID NOS: 14023-14025 |
| VCAN | Versican | SEQ ID NOS: 14026-14032 |
| VEGFA | Vascular endothelial growth factor A | SEQ ID NOS: 14033-14058 |
| VEGFB | Vascular endothelial growth factor B | SEQ ID NOS: 14059-14061 |
| VEGFC | Vascular endothelial growth factor C | SEQ ID NO: 14062 |
| FIGF | C-fos induced growth factor (vascular endothelial growth factor D) | SEQ ID NO: 14063 |
| VGF | VGF nerve growth factor inducible | SEQ ID NOS: 14064-14066 |
| VIP | Vasoactive intestinal peptide | SEQ ID NOS: 14067-14069 |
| VIPR2 | Vasoactive intestinal peptide receptor 2 | SEQ ID NOS: 14070-14073 |
| VIT | Vitrin | SEQ ID NOS: 14074-14081 |
| VKORC1 | Vitamin K epoxide reductase complex, subunit 1 | SEQ ID NOS: 14082-14089 |
| VLDLR | Very low density lipoprotein receptor | SEQ ID NOS: 14090-14092 |
| VMO1 | Vitelline membrane outer layer 1 homolog (chicken) | SEQ ID NOS: 14093-14096 |
| VNN1 | Vanin 1 | SEQ ID NO: 14097 |
| VNN2 | Vanin 2 | SEQ ID NOS: 14098-14111 |
| VNN3 | Vanin 3 | SEQ ID NOS: 14112-14123 |
| VOPP1 | Vesicular, overexpressed in cancer, prosurvival protein 1 | SEQ ID NOS: 14124-14136 |
| VPREB1 | Pre-B lymphocyte 1 | SEQ ID NOS: 14137-14138 |
| VPREB3 | Pre-B lymphocyte 3 | SEQ ID NOS: 14139-14140 |
| VPS37B | Vacuolar protein sorting 37 homolog B (S. cerevisiae) | SEQ ID NOS: 14141-14143 |
| VPS51 | Vacuolar protein sorting 51 homolog (S. cerevisiae) | SEQ ID NOS: 14144-14155 |
| VSIG1 | V-set and immunoglobulin domain containing 1 | SEQ ID NOS: 14156-14158 |
| VSIG10 | V-set and immunoglobulin domain containing 10 | SEQ ID NOS: 14159-14160 |
| VSTM1 | V-set and transmembrane domain containing 1 | SEQ ID NOS: 14161-14167 |
| VSTM2A | V-set and transmembrane domain containing 2A | SEQ ID NOS: 14168-14171 |
| VSTM2B | V-set and transmembrane domain containing 2B | SEQ ID NO: 14172 |
| VSTM2L | V-set and transmembrane domain containing 2 like | SEQ ID NOS: 14173-14175 |
| VSTM4 | V-set and transmembrane domain containing 4 | SEQ ID NOS: 14176-14177 |
| VTN | Vitronectin | SEQ ID NOS: 14178-14179 |
| VWA1 | Von Willebrand factor A domain containing 1 | SEQ ID NOS: 14180-14183 |
| VWA2 | Von Willebrand factor A domain containing 2 | SEQ ID NOS: 14184-14185 |
| VWA5B2 | Von Willebrand factor A domain containing 5B2 | SEQ ID NOS: 14186-14187 |
| VWA7 | Von Willebrand factor A domain containing 7 | SEQ ID NO: 14188 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
|---|---|---|
| VWC2 | Von Willebrand factor C domain containing 2 | SEQ ED NO: 14189 |
| VWC2L | Von Willebrand factor C domain containing protein 2-like | SEQ ID NOS: 14190-14191 |
| VWCE | Von Willebrand factor C and EGF domains | SEQ ID NOS: 14192-14196 |
| VWDE | Von Willebrand factor D and EGF domains | SEQ ID NOS: 14197-14202 |
| VWF | Von Willebrand factor | SEQ ID NOS: 14203-14205 |
| WDR25 | WD repeat domain 25 | SEQ ID NOS: 14206-14212 |
| WDR81 | WD repeat domain 81 | SEQ ID NOS: 14213-14222 |
| WDR90 | WD repeat domain 90 | SEQ ID NOS: 14223-14230 |
| WFDC1 | WAP four-disulfide core domain 1 | SEQ ID NOS: 14231-14233 |
| WFDC10A | WAP four-disulfide core domain 10A | SEQ ID NO: 14234 |
| WFDC10B | WAP four-disulfide core domain 10B | SEQ ID NOS: 14235-14236 |
| WFDC11 | WAP four-disulfide core domain 11 | SEQ ID NOS: 14237-14239 |
| WFDC12 | WAP four-disulfide core domain 12 | SEQ ID NO: 14240 |
| WFDC13 | WAP four-disulfide core domain 13 | SEQ ID NO: 14241 |
| WFDC2 | WAP four-disulfide core domain 2 | SEQ ID NOS: 14242-14246 |
| WFDC3 | WAP four-disulfide core domain 3 | SEQ ID NOS: 14247-14250 |
| WFDC5 | WAP four-disulfide core domain 5 | SEQ ID NOS: 14251-14252 |
| WFDC6 | WAP four-disulfide core domain 6 | SEQ ID NOS: 14253-14254 |
| WFDC8 | WAP four-disulfide core domain 8 | SEQ ID NOS: 14255-14256 |
| WFIKKN1 | WAP, follistatin/kazal, immunoglobulin, kunitz and netrin domain containing 1 | SEQ ID NO: 14257 |
| WFIKKN2 | WAP, follistatin/kazal, immunoglobulin, kunitz and netrin domain containing 2 | SEQ ID NOS: 14258-14259 |
| DFNB31 | Deafness, autosomal recessive 31 | SEQ ID NOS: 14260-14263 |
| WIF1 | WNT inhibitory factor I | SEQ ID NOS: 14264-14266 |
| WISP1 | WNT1 inducible signaling pathway protein 1 | SEQ ID NOS: 14267-14271 |
| WISP2 | WNT1 inducible signaling pathway protein 2 | SEQ ID NOS: 14272-14274 |
| WISP3 | WNT1 inducible signaling pathway protein 3 | SEQ ID NOS: 14275-14282 |
| WNK1 | WNK lysine deficient protein kinase 1 | SEQ ID NOS: 14283-14296 |
| WNT1 | Wingless-type MMTV integration site family, member 1 | SEQ ID NOS: 14297-14298 |
| WNT10B | Wingless-type MMTV integration site family, member 10B | SEQ ID NOS: 14299-14303 |
| WNT11 | Wingless-type MMTV integration site family, member 11 | SEQ ID NOS: 14304-14306 |
| WNT16 | Wingless-type MMTV integration site family, member 16 | SEQ ID NOS: 14307-14308 |
| WNT2 | Wingless-type MMTV integration site family member 2 | SEQ ID NOS: 14309-14311 |
| WNT3 | Wingless-type MMTV integration site family, member 3 | SEQ ID NO: 14312 |
| WNT3A | Wingless-type MMTV integration site family, member 3A | SEQ ID NO: 14313 |
| WNT5A | Wingless-type MMTV integration site family, member 5A | SEQ ID NOS: 14314-14317 |
| WNT5B | Wingless-type MMTV integration site family, member 5B | SEQ ID NOS: 14318-14324 |
| WNT6 | Wingless-type MMTV integration site family, member 6 | SEQ ID NO: 14325 |
| WNT7A | Wingless-type MMTV integration site family, member 7A | SEQ ID NO: 14326 |
| WNT7B | Wingless-type MMTV integration site family, member 7B | SEQ ID NOS: 14327-14331 |
| WNT8A | Wingless-type MMTV integration site family, member 8A | SEQ ID NOS: 14332-14335 |
| WNT8B | Wingless-type MMTV integration site family, member 8B | SEQ ID NO: 14336 |
| WNT9A | Wingless-type MMTV integration site family, member 9A | SEQ ID NO: 14337 |
| WNT9B | Wingless-type MMTV integration site family, member 9B | SEQ ID NOS: 14338-14340 |
| WSB1 | WD repeat and SOCS box containing 1 | SEQ ID NOS: 14341-14350 |
| WSCD1 | WSC domain containing 1 | SEQ ID NOS: 14351-14360 |
| WSCD2 | WSC domain containing 2 | SEQ ID NOS: 14361-14364 |
| XCL1 | Chemokine (C motif) ligand 1 | SEQ ID NO: 14365 |
| XCL2 | Chemokine (C motif) ligand 2 | SEQ ID NO: 14366 |
| XPNPEP2 | X-prolyl aminopeptidase (aminopeptidase P) 2, membrane-bound | SEQ ID NOS: 14367-14368 |
| XXYLT1 | Xyloside xylosyltransferase I | SEQ ID NOS: 14369-14374 |
| XYLT1 | Xylosyltransferase I | SEQ ID NO: 14375 |
| XYLT2 | Xylosyltransferase II | SEQ ID NOS: 14376-14381 |
| ZFYVE21 | Zinc finger, FYVE domain containing 21 | SEQ ID NOS: 14382-14386 |
| ZG16 | Zymogen granule protein 16 | SEQ ID NO: 14387 |

TABLE 1-continued

Exemplary therapeutic proteins (and proteins to enhance CAR-T efficacy). Compositions of the disclosure may comprise a promoter of one or more of the proteins of Table 1 driving expression of any sequence of the disclosure.

| Gene Name | Gene Description | Protein SEQ ID NO |
| --- | --- | --- |
| ZG16B | Zymogen granule protein 16B | SEQ ID NOS: 14388-14391 |
| ZIC4 | Zic family member 4 | SEQ ID NOS: 14392-14400 |
| ZNF207 | Zinc finger protein 207 | SEQ ID NOS: 14401-14411 |
| ZNF26 | Zinc finger protein 26 | SEQ ID NOS: 14412-14415 |
| ZNF34 | Zinc finger protein 34 | SEQ ID NOS: 14416-14419 |
| ZNF419 | Zinc finger protein 419 | SEQ ID NOS: 14420-14434 |
| ZNF433 | Zinc finger protein 433 | SEQ ID NOS: 14435-14444 |
| ZNF449 | Zinc finger protein 449 | SEQ ID NOS: 14445-14446 |
| ZNF488 | Zinc finger protein 488 | SEQ ID NOS: 14447-14448 |
| ZNF511 | Zinc finger protein 511 | SEQ ID NOS: 14449-14450 |
| ZNF570 | Zinc finger protein 570 | SEQ ID NOS: 14451-14456 |
| ZNF691 | Zinc finger protein 691 | SEQ ID NOS: 14457-14464 |
| ZNF98 | Zinc finger protein 98 | SEQ ID NOS: 14465-14468 |
| ZPBP | Zona pellucida binding protein | SEQ ID NOS: 14469-14472 |
| ZPBP2 | Zona pellucida binding protein 2 | SEQ ID NOS: 14473-14476 |
| ZSCAN29 | Zinc finger and SCAN domain containing 29 | SEQ ID NOS: 14477-14483 |

Expression of Cell Markers

In certain embodiments of the disclosure, T cells are modified to express detectable markers or indicators. In some embodiments, these detectable markers include, but are not limited to, fluorescent proteins. Non-limiting examples of fluorescent proteins include TagBFP, mTagBFP2, Azurite, EBFP2, mKalama1, Sirius, Sapphire, T-Sapphire, ECFP, Cerulean, SCFP3A, mTurquoise, mTurquoise2, monomeric Midorishi-Cyan, TagCFP, mTFP1, EGFP, Emerald, Superfolder GFP, monomeric Azami Green, mUKG, mWasabi, Clover, mNeonGreen, EYFP, Citrine, Venus, SYFP2, TagYFP, monomeric Kusabira Orange, mKok, mKO2, mOrange, mOrange2, mRaspberry, mCherr, mStrawberry, mTangerine, tdTomato, TagRFP, TagFRP-T, mApple, mRuby, mRuby2, mPlum, HcRed-Tandem, mKate2, mNeptune, NiRFP, TagRFP657, IFP1.4, mRFP, mKeima Red, LSS-mKate1, LSS-mKate2, mBeRFP and spectrally shifted variants thereof. In some embodiments of the disclosure, the detectable marker or indicator comprises luciferase. In some embodiments, the detectable marker or indicator is codon optimized for expression in humans. In some embodiments, the detectable marker or indicator is an intracellular marker or indicator. In some embodiments, the detectable marker or indicator is a cytoplasmic marker or indicator. In some embodiments, the detectable marker or indicator is a nuclear marker or indicator. In some embodiments, the detectable marker or indicator is a mitochondrial marker or indicator. In some embodiments, the detectable marker or indicator is a cell surface marker. In some embodiments, particularly those embodiments where the markers or indicators are cell surface markers, the marker or indicator may be tethered to the membrane of the cell. Cells modified to express markers with the compositions and methods of the disclosure can be used as indicator cells in vivo, ex vivo, in vitro and in situ. In certain embodiments of the disclosure, a marker or indicator is under the control of an inducible promoter of the disclosure such that when the inducible promoter is targeted, the promoter induces expression of the marker or indicator.

Inducible Promoters

In certain embodiments of the compositions of the disclosure, the sequence encoding the inducible promoter of (a) comprises a sequence encoding an NFκB promoter. In certain embodiments of the compositions of the disclosure, the sequence encoding the inducible promoter of (a) comprises a sequence encoding an interferon (IFN) promoter or a sequence encoding an interleukin-2 promoter. In certain embodiments, the interferon (IFN) promoter is an IFNγ promoter. In certain embodiments of the compositions of the disclosure, the inducible promoter is isolated or derived from the promoter of a cytokine or a chemokine. In certain embodiments, the cytokine or chemokine comprises IL2, IL3, IL4, IL5, IL6, IL10, IL12, IL13, IL17A/F, IL21, IL22, 1L23, transforming growth factor beta (TGFβ), colony stimulating factor 2 (GM-CSF), interferon gamma (IFNγ), Tumor necrosis factor (TNFα), LTα, perforin, Granzyme C (Gzmc), Granzyme B (Gzmb), C-C motif chemokine ligand 5 (CCL5), C-C motif chemokine ligand 4 (Ccl4), C-C motif chemokine ligand 3 (Ccl3), X-C motif chemokine ligand 1 (Xcl1) and LIF interleukin 6 family cytokine (Lif).

In certain embodiments of the compositions of the disclosure, the inducible promoter is isolated or derived from the promoter of a gene comprising a surface protein involved in cell differentiation, activation, exhaustion and function. In certain embodiments, the gene comprises CD69, CD71, CTLA4. PD-1, TIGIT, LAG3, TIM-3, GITR, MHCII, COX-2, FASL and 4-1BB.

In certain embodiments of the compositions of the disclosure, the inducible promoter is isolated or derived from the promoter of a gene involved in CD metabolism and differentiation. In certain embodiments of the compositions of the disclosure, the inducible promoter is isolated or derived from the promoter of Nr4a1, Nr4a3, Tnfrsf9 (4-1BB), Sema7a, Zfp3612, Gadd45b, Dusp5, Dusp6 and Neto2.

Nucleic Acid Molecules

Nucleic acid molecules of the disclosure encoding protein scaffolds can be in the form of RNA, such as mRNA, hnRNA, tRNA or any other form, or in the form of DNA, including, but not limited to, cDNA and genomic DNA obtained by cloning or produced synthetically, or any combinations thereof. The DNA can be triple-stranded, double-stranded or single-stranded, or any combination thereof. Any portion of at least one strand of the DNA or RNA can be the coding strand, also known as the sense strand, or it can be the non-coding strand, also referred to as the anti-sense strand.

Isolated nucleic acid molecules of the disclosure can include nucleic acid molecules comprising an open reading frame (ORF), optionally, with one or more introns, e.g., but not limited to, at least one specified portion of at least one protein scaffold; nucleic acid molecules comprising the coding sequence for a protein scaffold or loop region that binds to the target protein; and nucleic acid molecules which comprise a nucleotide sequence substantially different from those described above but which, due to the degeneracy of the genetic code, still encode the protein scaffold as described herein and/or as known in the art. Of course, the genetic code is well known in the art. Thus, it would be routine for one skilled in the art to generate such degenerate nucleic acid variants that code for specific protein scaffolds of the present invention. See, e.g., Ausubel, et al., supra, and such nucleic acid variants are included in the present invention.

As indicated herein, nucleic acid molecules of the disclosure which comprise a nucleic acid encoding a protein scaffold can include, but are not limited to, those encoding the amino acid sequence of a protein scaffold fragment, by itself; the coding sequence for the entire protein scaffold or a portion thereof; the coding sequence for a protein scaffold, fragment or portion, as well as additional sequences, such as the coding sequence of at least one signal leader or fusion peptide, with or without the aforementioned additional coding sequences, such as at least one intron, together with additional, non-coding sequences, including but not limited to, non-coding 5' and 3' sequences, such as the transcribed, non-translated sequences that play a role in transcription, mRNA processing, including splicing and polyadenylation signals (for example, ribosome binding and stability of mRNA); an additional coding sequence that codes for additional amino acids, such as those that provide additional functionalities. Thus, the sequence encoding a protein scaffold can be fused to a marker sequence, such as a sequence encoding a peptide that facilitates purification of the fused protein scaffold comprising a protein scaffold fragment or portion.

Polynucleotides Selectively Hybridizing to a Polynucleotide as Described Herein

The disclosure provides isolated nucleic acids that hybridize under selective hybridization conditions to a polynucleotide disclosed herein. Thus, the polynucleotides of this embodiment can be used for isolating, detecting, and/or quantifying nucleic acids comprising such polynucleotides. For example, polynucleotides of the present invention can be used to identify, isolate, or amplify partial or full-length clones in a deposited library. In some embodiments, the polynucleotides are genomic or cDNA sequences isolated, or otherwise complementary to, a cDNA from a human or mammalian nucleic acid library.

Preferably, the cDNA library comprises at least 80% full-length sequences, preferably, at least 85% or 90% full-length sequences, and, more preferably, at least 95% full-length sequences. The cDNA libraries can be normalized to increase the representation of rare sequences. Low or moderate stringency hybridization conditions are typically, but not exclusively, employed with sequences having a reduced sequence identity relative to complementary sequences. Moderate and high stringency conditions can optionally be employed for sequences of greater identity. Low stringency conditions allow selective hybridization of sequences having about 70% sequence identity and can be employed to identify orthologous or paralogous sequences.

Optionally, polynucleotides of this invention will encode at least a portion of a protein scaffold encoded by the polynucleotides described herein. The polynucleotides of this invention embrace nucleic acid sequences that can be employed for selective hybridization to a polynucleotide encoding a protein scaffold of the present invention. See, e.g., Ausubel, supra; Colligan, supra, each entirely incorporated herein by reference.

Construction of Nucleic Acids

The isolated nucleic acids of the disclosure can be made using (a) recombinant methods, (b) synthetic techniques, (c) purification techniques, and/or (d) combinations thereof, as well-known in the art.

The nucleic acids can conveniently comprise sequences in addition to a polynucleotide of the present invention. For example, a multi-cloning site comprising one or more endonuclease restriction sites can be inserted into the nucleic acid to aid in isolation of the polynucleotide. Also, translatable sequences can be inserted to aid in the isolation of the translated polynucleotide of the disclosure. For example, a hexa-histidine marker sequence provides a convenient means to purify the proteins of the disclosure. The nucleic acid of the disclosure, excluding the coding sequence, is optionally a vector, adapter, or linker for cloning and/or expression of a polynucleotide of the disclosure.

Additional sequences can be added to such cloning and/or expression sequences to optimize their function in cloning and/or expression, to aid in isolation of the polynucleotide, or to improve the introduction of the polynucleotide into a cell. Use of cloning vectors, expression vectors, adapters, and linkers is well known in the art. (See, e.g., Ausubel, supra; or Sambrook, supra).

Recombinant Methods for Constructing Nucleic Acids

The isolated nucleic acid compositions of this disclosure, such as RNA, cDNA, genomic DNA, or any combination thereof, can be obtained from biological sources using any number of cloning methodologies known to those of skill in the art. In some embodiments, oligonucleotide probes that selectively hybridize, under stringent conditions, to the polynucleotides of the present invention are used to identify the desired sequence in a cDNA or genomic DNA library. The isolation of RNA, and construction of cDNA and genomic libraries are well known to those of ordinary skill in the art. (See, e.g., Ausubel, supra; or Sambrook, supra).

Nucleic Acid Screening and Isolation Methods

A cDNA or genomic library can be screened using a probe based upon the sequence of a polynucleotide of the disclosure. Probes can be used to hybridize with genomic DNA or cDNA sequences to isolate homologous genes in the same or different organisms. Those of skill in the art will appreciate that various degrees of stringency of hybridization can be employed in the assay; and either the hybridization or the wash medium can be stringent. As the conditions for hybridization become more stringent, there must be a greater degree of complementarity between the probe and the target for duplex formation to occur. The degree of stringency can be controlled by one or more of temperature, ionic strength, pH and the presence of a partially denaturing solvent, such as formamide. For example, the stringency of hybridization is conveniently varied by changing the polarity of the reactant solution through, for example, manipulation of the concentration of formamide within the range of 0% to 50%. The degree of complementarity (sequence identity) required for detectable binding will vary in accordance with the stringency of the hybridization medium and/or wash medium. The degree of complementarity will optimally be 100%, or 70-100%, or any range or value therein. However, it should be understood that minor sequence variations in the probes and primers can be compensated for by reducing the stringency of the hybridization and/or wash medium.

Methods of amplification of RNA or DNA are well known in the art and can be used according to the disclosure without undue experimentation, based on the teaching and guidance presented herein.

Known methods of DNA or RNA amplification include, but are not limited to, polymerase chain reaction (PCR) and related amplification processes (see, e.g., U.S. Pat. Nos. 4,683,195, 4,683,202, 4,800,159, 4,965,188, to Mullis, et al.; U.S. Pat. Nos. 4,795,699 and 4,921,794 to Tabor, et al; U.S. Pat. No. 5,142,033 to Innis; U.S. Pat. No. 5,122,464 to Wilson, et al.; U.S. Pat. No. 5,091,310 to Innis; U.S. Pat. No. 5,066,584 to Gyllensten, et al; U.S. Pat. No. 4,889,818 to Gelfand, et al; U.S. Pat. No. 4,994,370 to Silver, et al; U.S. Pat. No. 4,766,067 to Biswas; U.S. Pat. No. 4,656,134 to Ringold) and RNA mediated amplification that uses antisense RNA to the target sequence as a template for double-stranded DNA synthesis (U.S. Pat. No. 5,130,238 to Malek, et al, with the tradename NASBA), the entire contents of which references are incorporated herein by reference. (See, e.g., Ausubel, supra; or Sambrook, supra.)

For instance, polymerase chain reaction (PCR) technology can be used to amplify the sequences of polynucleotides of the disclosure and related genes directly from genomic DNA or cDNA libraries. PCR and other in vitro amplification methods can also be useful, for example, to clone nucleic acid sequences that code for proteins to be expressed, to make nucleic acids to use as probes for detecting the presence of the desired mRNA in samples, for nucleic acid sequencing, or for other purposes. Examples of techniques sufficient to direct persons of skill through in vitro amplification methods are found in Berger, supra, Sambrook, supra, and Ausubel, supra, as well as Mullis, et al., U.S. Pat. No. 4,683,202 (1987); and Innis, et al., PCR Protocols A Guide to Methods and Applications, Eds., Academic Press Inc., San Diego, Calif. (1990). Commercially available kits for genomic PCR amplification are known in the art. See, e.g., Advantage-GC Genomic PCR Kit (Clontech). Additionally, e.g., the T4 gene 32 protein (Boehringer Mannheim) can be used to improve yield of long PCR products.

Synthetic Methods for Constructing Nucleic Acids

The isolated nucleic acids of the disclosure can also be prepared by direct chemical synthesis by known methods (see, e.g., Ausubel, et al., supra). Chemical synthesis generally produces a single-stranded oligonucleotide, which can be converted into double-stranded DNA by hybridization with a complementary sequence, or by polymerization with a DNA polymerase using the single strand as a template. One of skill in the art will recognize that while chemical synthesis of DNA can be limited to sequences of about 100 or more bases, longer sequences can be obtained by the ligation of shorter sequences.

Recombinant Expression Cassettes

The disclosure further provides recombinant expression cassettes comprising a nucleic acid of the disclosure. A nucleic acid sequence of the disclosure, for example, a cDNA or a genomic sequence encoding a protein scaffold of the disclosure, can be used to construct a recombinant expression cassette that can be introduced into at least one desired host cell. A recombinant expression cassette will typically comprise a polynucleotide of the disclosure operably linked to transcriptional initiation regulatory sequences that will direct the transcription of the polynucleotide in the intended host cell. Both heterologous and non-heterologous (i.e., endogenous) promoters can be employed to direct expression of the nucleic acids of the disclosure.

In some embodiments, isolated nucleic acids that serve as promoter, enhancer, or other elements can be introduced in the appropriate position (upstream, downstream or in the intron) of a non-heterologous form of a polynucleotide of the disclosure so as to up or down regulate expression of a polynucleotide of the disclosure. For example, endogenous promoters can be altered in vivo or in vitro by mutation, deletion and/or substitution.

Vectors and Host Cells

The disclosure also relates to vectors that include isolated nucleic acid molecules of the disclosure, host cells that are genetically engineered with the recombinant vectors, and the production of at least one protein scaffold by recombinant techniques, as is well known in the art. See, e.g., Sambrook, et al., supra; Ausubel, et al., supra, each entirely incorporated herein by reference.

For example, the PB-EF1a vector may be used. The vector comprises the following nucleotide sequence:

(SEQ ID NO. 17073)

```
tgtacatagattaaccctagaaagataatcatattgtgacgtacgttaaagataatcatgcgtaaaattgacgcatgtgttttat
cggtctgtatatcgaggtttatttattaatttgaatagatattaagttttattatatttacacttacatactaataataaattca
acaaacaatttatttatgttttatttatttattaaaaaaaaacaaaaactcaaaatttcttctataaagtaacaaaacttttatcg
aatacctgcagcccgggggatgcagagggacagcccccccccaaagccccagggatgtaattacgtccctcccccgctaggggg
cagcagcgagccgcccggggctccgctccggtccggcgctcccccgcatcccgagccggcagcgtgcggggacagcccgggca
cggggaaggtggcacgggatcgctttcctctgaacgcttctcgctgctctttgagcctgcagacacctgggggatacggggaaa
agttgactgtgcctttcgatcgaaccatggacagttagctttgcaaagatggataaagttttaaacagagaggaatctttgcagc
taatggaccttctaggtcttgaaaggagtgggaattggctccggtgcccgtcagtgggcagagcgcacatcgcccacagtcccg
agaagttgggggagggtcggcaattgaaccggtgcctagagaaggtggcgcggggtaaactgggaaagtgatgtcgtgtactg
gctccgccttttcccgagggtggggagaaccgtatataagtgcagtagtcgccgtgaacgttctttttcgcaacgggtttgcc
gccagaacacaggtaagtgccgtgtgtggttcccgcgggcctggcctctttacgggttatggcccttgcgtgccttgaattactt
ccacctggctgcagtacgtgattcttgatcccgagcttcggggttggaagtgggtgggagagttcgaggccttgcgcttaaggagc
cccttcgcctcgtgcttgagttgaggcctggcctgggcgctggggccgccgcgtgcgaatctggtggcaccttcgcgcctgtctc
gctgctttcgataagtctctagccatttaaaattttttgatgacctgctgcgacgcttttttttctggcaagatagtcttgtaaatg
```

-continued

```
cggcccaagatctgcacactggtatttcggttttttggggccgcgggcggcgacgggcccgtgcgtcccagcgcacatgttcggc
gaggcggggcctgcgagcgcggccaccgagaatcggacgggggtagtctcaagctggccggcctgctctggtgcctggcctcgcg
ccgccgtgtatcgccccgccctgggcggcaaggctggcccggtcggcaccagttgcgtgagcggaaagatggccgcttcccggcc
ctgctgcagggagctcaaaatggaggacgcggcgctcgggagagcggcgggtgagtcacccacacaaaggaaaagggcctttcc
gtcctcagccgtcgcttcatgtgactccacggagtaccgggcgccgtccaggcacctcgattagttctcgagcttttggagtacg
tcgtctttaggttgggggaggggttttatgcgatggagtttccccacactgagtgggtggagactgaagttaggccagcttggc
acttgatgtaattctccttggaatttgccctttttgagtttggatcttggttcattctcaagcctcagacagtggttcaaagttt
ttttcttccatttcaggtgtcgtgagaattctaatacgactcactatagggtgtgctgtctcatcattttggcaaagattggcca
ccaagcttgtcctgcaggagggtcgacgcctctagacgggcggccgctccggatccacgggtaccgatcacatatgcctttaatt
aaacactagttctatagtgtcacctaaattcccttagtgagggttaatggccgtaggccgccagaattgggtccagacatgata
agatacattgatgagtttggacaaaccacaactagaatgcagtgaaaaaaatgctttatttgtgaaatttgtgatgctattgctt
tatttgtaaccattataagctgcaataaacaagttaacaacaacaattgcattcattttatgtttcaggttcaggggggaggtgtg
ggaggttttttcggactctaggacctgcgcatgcgcttggcgtaatcatggtcatagctgtttcctgttttccccgtatccccc
aggtgtctgcaggctcaaagagcagcgagaagcgttcagaggaaagcgatcccgtgccacctccccgtgcccgggctgtccccg
cacgctgccggctcggggatgcggggggagcgccggaccggagcggagccccgggcggctcgctgctgcccctagcgggggagg
gacgtaattacatccctgggggctttggggggggctgtccctctcaccgcggtggagctccagcttttgttcgaattgggccc
cccctcgagggtatcgatgatatctataacaagaaaatatatataataagttatcacgtaagtagaacatgaaataacaatat
aattatcgtatgagttaaatcttaaaagtcacgtaaaagataatcatgcgtcattttgactcacgcggtcgttatagttcaaaat
cagtgacacttaccgcattgacaagcacgcctcacgggagctccaagcggcgactgagatgtcctaaatgcacagcgacggattc
gcgctatttagaaagagagcaatatttcaagaatgcatgcgtcaatttttacgcagactatctttctagggttaatctagctag
ccttaagsgcgcctattgcgttgcgctcactgcccgctttccagtcgggaaacctgtcgtgccagctgcattaatgaatcggcca
acgcgcggggagaggcggtttgcgtattgggcgctcttccgcttcctcgctcactgactcgctgcgctcggtcgttcggctgcgg
cgagcggtatcagctcactcaaaggcggtaatacggttatccacagaatcagggggataacgcaggaaagaacatgaccaaaatcc
cttaacgtgagttttcgttccactgagcgtcagacccgtagaaaagatcaaaggatcttcttgagatccttttttttctgcgcgt
aatctgctgcttgcaaacaaaaaaaccaccgctaccagcggtggtttgtttgccggatcaagagctaccaactctttttccgaag
gtaactggcttcagcagagcgcagataccaaatactgttcttctagtgtagccgtagttaggccaccacttcaagaactctgtag
caccgcctacatacctcgctctgctaatcctgttaccagtggctgctgccagtggcgataagtcgtgtcttaccgggttggactc
aagacgatagttaccggataaggcgcagcggtcgggctgaacggggggttcgtgcacacagcccagcttggagcgaacgacctac
accgaactgagataccacagcgtgagctatgagaaagcgccacgcttcccgaagggagaaaggcggacaggtatccggtaagcg
gcagggtcggaacaggagagcgcacgagggagcttccaggggaaacgcctggtatctttatagtcctgtcgggtttcgccacct
ctgacttgagcgtcgatttttgtgatgctcgtcaggggggcggagcctatggaaaaacgccagcaacgcggcctttttacggttc
ctggccttttgctggccttttgctcacatgagattatcaaaaaggatcttcacctagatcctttttaaattaaaaatgaagtttta
aatcaatctaaagtatatatgagtaaacttggtctgacagtcagaagaactcgtcaagaaggcgatagaaggcgatgcgctgcga
atcgggagcggcgataccgtaaagcacgaggaagcggtcagcccattcgccgccaagctcttcagcaatatcacgggtagccaac
gctatgtcctgatagcggtccgccacacccagccggccacagtcgatgaatccagaaaagcggccattttccaccatgatattcg
caagcaggcatcgccatgggtcacgacgagatcctcgccgtcgggcatgctcgccttgagcctggcgaacagttcggctggcgc
gagcccctgatgctcttcgtccagatcatcctgatcgacaagaccggcttccatccgagtacgtgctcgctcgatgcgatgtttc
gcttggtggtcgaatgggcaggtagccggatcaagcgtatgcagccgccgcattgcatcagccatgatggatactttctcggcag
gagcaaggtgagatgacaggagatcctgccccggcacttcgcccaatagcagccagtcccttcccgcttcagtgacaacgtcgag
cacagctgcgcaaggaacgcccgtcgtggccagccacgatagccgcgctgcctcgtcttgcagttcattcagggcaccggacagg
```

-continued
```
tcggtcttgacaaaaagaaccgggcgccctgcgctgacagccggaacacggcggcatcagagcagccgattgtctgttgtgccc agtcatagccgaatagcctctccacccaagcggccggagaacctgcgtgcaatccatcttgttcaatcataatattattgaagca tttatcagggttcgtctcgtcccggtctcctcccaatgcatgtcaatattggccattagccatattattcattggttatatagca taaatcaatattggctattggccattgcatacgttgtatctatatcataata.
```

The polynucleotides can optionally be joined to a vector containing a selectable marker for propagation in a host. Generally, a plasmid or nanoplasmid vector is introduced in a precipitate, such as a calcium phosphate precipitate, or in a complex with a charged lipid. If the vector is a virus, it can be packaged in vitro using an appropriate packaging cell line and then transduced into host cells.

The DNA insert should be operatively linked to an appropriate promoter. The expression constructs will further contain sites for transcription initiation, termination and, in the transcribed region, a ribosome binding site for translation. The coding portion of the mature transcripts expressed by the constructs will preferably include a translation initiating at the beginning and a termination codon (e.g., UAA, UGA or UAG) appropriately positioned at the end of the mRNA to be translated, with UAA and UAG preferred for mammalian or eukaryotic cell expression.

Expression vectors will preferably but optionally include at least one selectable marker. Such markers include, e.g., but are not limited to, ampicillin, zeocin (sh bla gene), puromycin (pac gene), hygromycin B (hygB gene), G418/Geneticin (neo gene), mycophenolic acid, or glutamine synthetase (GS, U.S. Pat. Nos. 5,122,464; 5,770,359; 5,827,739), blasticidin (bsd gene), resistance genes for eukaryotic cell culture as well as ampicillin, zeocin (Sh bla gene), puromycin (pac gene), hygromycin B (hvgB gene), G418/Geneticin (neo gene), kanamycin, spectinomycin, streptomycin, carbenicillin, bleomycin, erythromycin, polymyxin B, or tetracycline resistance genes for culturing in E. coli and other bacteria or prokaryotics (the above patents are entirely incorporated hereby by reference). Appropriate culture mediums and conditions for the above-described host cells are known in the art. Suitable vectors will be readily apparent to the skilled artisan. Introduction of a vector construct into a host cell can be effected by calcium phosphate transfection, DEAE-dextran mediated transfection, cationic lipid-mediated transfection, electroporation, transduction, infection or other known methods. Such methods are described in the art, such as Sambrook, supra, Chapters 1-4 and 16-18; Ausubel, supra, Chapters 1, 9, 13, 15, 16.

Expression vectors will preferably but optionally include at least one selectable cell surface marker for isolation of cells modified by the compositions and methods of the disclosure. Selectable cell surface markers of the disclosure comprise surface proteins, glycoproteins, or group of proteins that distinguish a cell or subset of cells from another defined subset of cells. Preferably the selectable cell surface marker distinguishes those cells modified by a composition or method of the disclosure from those cells that are not modified by a composition or method of the disclosure. Such cell surface markers include, e.g., but are not limited to, "cluster of designation" or "classification determinant" proteins (often abbreviated as "CD") such as a truncated or full length form of CD19, CD271, CD34, CD22, CD20, CD33, CD52, or any combination thereof. Cell surface markers further include the suicide gene marker RQR8 (Philip B et al. Blood. 2014 Aug. 21; 124(8):1277-87).

Expression vectors will preferably but optionally include at least one selectable drug resistance marker for isolation of cells modified by the compositions and methods of the disclosure. Selectable drug resistance markers of the disclosure may comprise wild-type or mutant Neo, DHFR, TYMS, FRANCF, RAD51C, GCS, MDR1, ALDH1, NKX2.2, or any combination thereof.

At least one protein scaffold of the disclosure can be expressed in a modified form, such as a fusion protein, and can include not only secretion signals, but also additional heterologous functional regions. For instance, a region of additional amino acids, particularly charged amino acids, can be added to the N-terminus of a protein scaffold to improve stability and persistence in the host cell, during purification, or during subsequent handling and storage. Also, peptide moieties can be added to a protein scaffold of the disclosure to facilitate purification. Such regions can be removed prior to final preparation of a protein scaffold or at least one fragment thereof. Such methods are described in many standard laboratory manuals, such as Sambrook, supra, Chapters 17.29-17.42 and 18.1-18.74; Ausubel, supra. Chapters 16, 17 and 18.

Those of ordinary skill in the art are knowledgeable in the numerous expression systems available for expression of a nucleic acid encoding a protein of the disclosure. Alternatively, nucleic acids of the disclosure can be expressed in a host cell by turning on (by manipulation) in a host cell that contains endogenous DNA encoding a protein scaffold of the disclosure. Such methods are well known in the art, e.g., as described in U.S. Pat. Nos. 5,580,734, 5,641,670, 5,733,746, and 5,733,761, entirely incorporated herein by reference.

Illustrative of cell cultures useful for the production of the protein scaffolds, specified portions or variants thereof, are bacterial, yeast, and mammalian cells as known in the art. Mammalian cell systems often will be in the form of monolayers of cells although mammalian cell suspensions or bioreactors can also be used. A number of suitable host cell lines capable of expressing intact glycosylated proteins have been developed in the art, and include the COS-1 (e.g., ATCC CRL 1650), COS-7 (e.g., ATCC CRL-1651), HEK293, BHK21 (e.g., ATCC CRL-10), CHO (e.g., ATCC CRL 1610) and BSC-1 (e.g., ATCC CRL-26) cell lines, Cos-7 cells, CHO cells, hep G2 cells, P3X63Ag8.653, SP2/0-Ag14, 293 cells, HeLa cells and the like, which are readily available from, for example, American Type Culture Collection, Manassas, Va. (www.atcc.org). Preferred host cells include cells of lymphoid origin, such as myeloma and lymphoma cells. Particularly preferred host cells are P3X63Ag8.653 cells (ATCC Accession Number CRL-1580) and SP2/0-Ag14 cells (ATCC Accession Number CRL-1851). In a particularly preferred embodiment, the recombinant cell is a P3X63Ab8.653 or an SP2/0-Ag14 cell.

Expression vectors for these cells can include one or more of the following expression control sequences, such as, but not limited to, an origin of replication; a promoter (e.g., late or early SV40 promoters, the CMV promoter (U.S. Pat. Nos. 5,168,062; 5,385,839), an HSV tk promoter, a pgk (phosphoglycerate kinase) promoter, an EF-1 alpha promoter (U.S. Pat. No. 5,266,491), at least one human promoter; an enhancer, and/or processing information sites, such as ribosome binding sites, RNA splice sites, polyadenylation sites (e.g., an SV40 large T Ag poly A addition site), and transcriptional terminator sequences. See, e.g., Ausubel et al., supra; Sambrook, et al., supra. Other cells useful for production of nucleic acids or proteins of the present invention are known and/or available, for instance, from the American Type Culture Collection Catalogue of Cell Lines and Hybridomas (www.atcc.org) or other known or commercial sources.

When eukaryotic host cells are employed, polyadenylation or transcription terminator sequences are typically incorporated into the vector. An example of a terminator sequence is the polyadenlyation sequence from the bovine growth hormone gene. Sequences for accurate splicing of the transcript can also be included. An example of a splicing sequence is the VP1 intron from SV40 (Sprague, et al., J. Virol. 45:773-781 (1983)). Additionally, gene sequences to control replication in the host cell can be incorporated into the vector, as known in the art.

Amino Acid Codes

The amino acids that make up protein scaffolds of the disclosure are often abbreviated. The amino acid designations can be indicated by designating the amino acid by its single letter code, its three letter code, name, or three nucleotide codon(s) as is well understood in the art (see Alberts, B., et al., Molecular Biology of The Cell, Third Ed., Garland Publishing, Inc., New York, 1994). A protein scaffold of the disclosure can include one or more amino acid substitutions, deletions or additions, either from natural mutations or human manipulation, as specified herein. Amino acids in a protein scaffold of the disclosure that are essential for function can be identified by methods known in the art, such as site-directed mutagenesis or alanine-scanning mutagenesis (e.g., Ausubel, supra, Chapters 8, 15; Cunningham and Wells, Science 244:1081-1085 (1989)). The latter procedure introduces single alanine mutations at every residue in the molecule. The resulting mutant molecules are then tested for biological activity, such as, but not limited to, at least one neutralizing activity. Sites that are critical for protein scaffold binding can also be identified by structural analysis, such as crystallization, nuclear magnetic resonance or photoaffinity labeling (Smith, et al., J. Mol. Biol. 224:899-904 (1992) and de Vos, et al., Science 255: 306-312 (1992)).

As those of skill will appreciate, the invention includes at least one biologically active protein scaffold of the disclosure. Biologically active protein scaffolds have a specific activity at least 20%, 30%, or 40%, and, preferably, at least 50%, 60%, or 70%, and, most preferably, at least 80%, 90%, or 95%-99% or more of the specific activity of the native (non-synthetic), endogenous or related and known protein scaffold. Methods of assaying and quantifying measures of enzymatic activity and substrate specificity are well known to those of skill in the art.

In another aspect, the disclosure relates to protein scaffolds and fragments, as described herein, which are modified by the covalent attachment of an organic moiety. Such modification can produce a protein scaffold fragment with improved pharmacokinetic properties (e.g., increased in vivo serum half-life). The organic moiety can be a linear or branched hydrophilic polymeric group, fatty acid group, or fatty acid ester group. In particular embodiments, the hydrophilic polymeric group can have a molecular weight of about 800 to about 120,000 Daltons and can be a polyalkane glycol (e.g., polyethylene glycol (PEG), polypropylene glycol (PPG)), carbohydrate polymer, amino acid polymer or polyvinyl pyrolidone, and the fatty acid or fatty acid ester group can comprise from about eight to about forty carbon atoms.

T Cell Isolation From a Leukopheresis Product

A leukapheresis product or blood may be collected from a subject at clinical site using a closed system and standard methods (e.g., a COBE Spectra Apheresis System) Preferably, the product is collected according to standard hospital or institutional Leukapheresis procedures in standard Leukapheresis collection bags. For example, in preferred embodiments of the methods of the disclosure, no additional anticoagulants or blood additives (heparin, etc.) are included beyond those normally used during leukapheresis.

Alternatively, white blood cells (WBC)/Peripheral Blood Mononuclear Cells (PBMC) (using Biosafe Sepax 2 (Closed/Automated)) or T cells (using CliniMACS® Prodigy (Closed/Automated)) may be isolated directly from whole blood. However, in certain subjects (e.g. those diagnosed and/or treated for cancer), the WBC/PBMC yield may be significantly lower when isolated from whole blood than when isolated by leukapheresis.

Either the leukapheresis procedure and/or the direct cell isolation procedure may be used for any subject of the disclosure.

The leukapheresis product, blood. WBC/PBMC composition and/or T-cell composition should be packed in insulated containers and should be kept at controlled room temperature (+19° C. to +25° C.) according to standard hospital of institutional blood collection procedures approved for use with the clinical protocol. The leukapheresis product, blood, WBC/PBMC composition and/or T-cell composition should not be refrigerated.

The cell concentration leukapheresis product, blood. WBC/PBMC composition and/or T-cell composition should not exceed $0.2 \times 10^9$ cells per mL during transportation. Intense mixing of the leukapheresis product, blood. WBC/PBMC composition and/or T-cell composition should be avoided.

If the leukapheresis product, blood, WBC/PBMC composition and/or T-cell composition has to be stored, e.g. overnight, it should be kept at controlled room temperature (same as above). During storage, the concentration of the leukapheresis product, blood, WBC/PBMC composition and/or T-cell composition should never exceed $0.2 \times 10^9$ cell per mL.

Preferably, cells of the leukapheresis product, blood, WBC/PBMC composition and/or T-cell composition should be stored in autologous plasma. In certain embodiments, if the cell concentration of the leukapheresis product, blood. WBC/PBMC composition and/or T-cell composition is higher than $0.2 \times 10^9$ cell per mL, the product should be diluted with autologous plasma.

Preferably, the leukapheresis product, blood, WBC/PBMC composition and/or T-cell composition should not be older than 24 hours when starting the labeling and separation procedure. The leukapheresis product, blood, WBC/PBMC composition and/or T-cell composition may be processed and/or prepared for cell labeling using a closed and/or automated system (e.g., CliniMACS Prodigy).

An automated system may perform additional buffy coat isolation, possibly by ficolation, and/or washing of the cellular product (e.g., the leukapheresis product, blood. WBC/PBMC composition and/or T cell composition).

A closed and/or automated system may be used to prepare and label cells for T-Cell isolation (from, for example, the leukapheresis product, blood, WBC/PBMC composition and/or T cell composition).

Although WBC/PBMCs may be nucleofected directly (which is easier and saves additional steps), the methods of the disclosure may include first isolating T cells prior to nucleofection. The easier strategy of directly nucleofecting PBMC requires selective expansion of CAR+ cells that is mediated via CAR signaling, which by itself is proving to be an inferior expansion method that directly reduces the in vivo efficiency of the product by rendering T cells functionally exhausted. The product may be a heterogeneous composition of CAR+ cells including T cells, NK cells, NKT cells, monocytes, or any combination thereof, which increases the variability in product from patient to patient and makes dosing and CRS management more difficult. Since T cells are thought to be the primary effectors in tumor suppression and killing, T cell isolation for the manufacture of an autologous product may result in significant benefits over the other more heterogeneous composition.

T cells may be isolated directly, by enrichment of labeled cells or depletion of labeled cells in a one-way labeling procedure or, indirectly, in a two-step labeling procedure. According to certain enrichment strategies of the disclosure, T cells may be collected in a Cell Collection Bag and the non-labeled cells (non-target cells) in a Negative Fraction Bag. In contrast to an enrichment strategy of the disclosure, the non-labeled cells (target cells) are collected in a Cell Collection Bag and the labeled cells (non-target cells) are collected in a Negative Fraction Bag or in the Non-Target Cell Bag, respectively. Selection reagents may include, but are not limited to, antibody-coated beads. Antibody-coated beads may either be removed prior to a modification and/or an expansion step, or, retained on the cells prior to a modification and/or an expansion step. One or more of the following non-limiting examples of cellular markers may be used to isolate T-cells: CD3, CD4, CD8, CD25, anti-biotin, CD1c, CD3/CD19, CD3/CD56, CD14, CD19, CD34, CD45RA, CD56, CD62L, CD133, CD137, CD271, CD304, IFN-gamma, TCR alpha/beta, and/or any combination thereof. Methods for the isolation of T-cells may include one or more reagents that specifically bind and/or detectably-label one or more of the following non-limiting examples of cellular markers may be used to isolate T-cells. CD3, CD4, CD8, CD25, anti-biotin, CD1c, CD3/CD19, CD3/CD56, CD14, CD19, CD34, CD45RA, CD56, CD62L, CD133, CD137. CD271, CD304, IFN-gamma, TCR alpha/beta, and/ or any combination thereof. These reagents may or may not be "Good Manufacturing Practices" ("GMP") grade. Reagents may include, but are not limited to, Thermo DynaBeads and Miltenyi CliniMACS products. Methods of isolating T-cells of the disclosure may include multiple iterations of labeling and/or isolation steps. At any point in the methods of isolating T-cells of the disclosure, unwanted cells and/or unwanted cell types may be depleted from a T cell product composition of the disclosure by positively or negatively selecting for the unwanted cells and/or unwanted cell types. A T cell product composition of the disclosure may contain additional cell types that may express CD4, CD8, and/or another T cell marker(s).

Methods of the disclosure for nucleofection of T cells may eliminate the step of T cell isolation by, for example, a process for nucleofection of T cells in a population or composition of WBC/PBMCs that, following nucleofection, includes an isolation step or a selective expansion step via TCR signaling.

Certain cell populations may be depleted by positive or negative selection before or after T cell enrichment and/or sorting. Examples of cell compositions that may be depleted from a cell product composition may include myeloid cells, CD25+ regulatory T cells (T Regs), dendritic cells, macrophages, red blood cells, mast cells, gamma-delta T cells, natural killer (NK) cells, a Natural Killer (NK)-like cell (e.g. a Cytokine Induced Killer (CIK) cell), induced natural killer (iNK) T cells, NK T cells, B cells, or any combination thereof.

T cell product compositions of the disclosure may include CD4+ and CD8+ T-Cells. CD4+ and CD8+ T-Cells may be isolated into separate collection bags during an isolation or selection procedure. CD4+ T cells and CD8+ T cells may be further treated separately, or treated after reconstitution (combination into the same composition) at a particular ratio.

The particular ratio at which CD4+ T cells and CD8+ T cells may be reconstituted may depend upon the type and efficacy of expansion technology used, cell medium, and/or growth conditions utilized for expansion of T-cell product compositions. Examples of possible CD4+: CD8+ ratios include, but are not limited to, 50%:50%, 60%:40%, 40%: 60% 75%:25% and 25%:75%.

CD8+ T cells exhibit a potent capacity for tumor cell killing, while CD4+ T cells provide many of the cytokines required to support CD8+ T cell proliferative capacity and function. Because T cells isolated from normal donors are predominantly CD4+, the T-cell product compositions are artificially adjusted in vitro with respect to the CD4+:CD8+ ratio to improve upon the ratio of CD4+ T cells to CD8+ T cells that would otherwise be present in vivo. An optimized ratio may also be used for the ex vivo expansion of the autologous T-cell product composition. In view of the artificially adjusted CD4+:CD8+ ratio of the T-cell product composition, it is important to note that the product compositions of the disclosure may be significantly different and provide significantly greater advantage than any endogenously-occurring population of T-cells.

Preferred methods for T cell isolation may include a negative selection strategy for yielding untouched pan T cell, meaning that the resultant T-cell composition includes T-cells that have not been manipulated and that contain an endogenously-occurring variety/ratio of T-cells.

Reagents that may be used for positive or negative selection include, but are not limited to, magnetic cell separation beads. Magnetic cell separation beads may or may not be removed or depleted from selected populations of CD4+ T cells, CD8+ T cells, or a mixed population of both CD4+ and CD8+ T cells before performing the next step in a T-cell isolation method of the disclosure.

T cell compositions and T cell product compositions may be prepared for cryopreservation, storage in standard T Cell Culture Medium. and/or genetic modification.

T cell compositions, T cell product compositions, unstimulated T cell compositions, resting T cell compositions or any portion thereof may be cryopreserved using a standard cryopreservation method optimized for storing and recovering human cells with high recovery, viability, phenotype, and/or functional capacity. Commercially-available cryopreservation media and/or protocols may be used. Cryopreservation methods of the disclosure may include a DMSO free cryopreservant (e.g. CryoSOfree™ DMSO-free Cryopreservation Medium) reduce freezing-related toxicity.

T cell compositions, T cell product compositions, unstimulated T cell compositions, resting T cell compositions or any portion thereof may be stored in a culture medium. T cell culture media of the disclosure may be optimized for cell storage, cell genetic modification, cell phenotype and/or cell expansion. T cell culture media of the disclosure may include one or more antibiotics. Because the inclusion of an antibiotic within a cell culture media may decrease transfection efficiency and/or cell yield following genetic modification via nucleofection, the specific antibiotics (or combinations thereof) and their respective concentration(s) may be altered for optimal transfection efficiency and/or cell yield following genetic modification via nucleofection.

T cell culture media of the disclosure may include serum, and, moreover, the serum composition and concentration may be altered for optimal cell outcomes. Human AB serum is preferred over FBS/FCS for culture of T cells because, although contemplated for use in T cell culture media of the disclosure, FBS/FCS may introduce xeno-proteins. Serum may be isolated form the blood of the subject for whom the T-cell composition in culture is intended for administration, thus, a T cell culture medium of the disclosure may comprise autologous serum. Serum-free media or serum-substitute may also be used in T-cell culture media of the disclosure. In certain embodiments of the T-cell culture media and methods of the disclosure, serum-free media or serum-substitute may provide advantages over supplementing the medium with xeno-serum, including, but not limited to, healthier cells that have greater viability, nucleofect with higher efficiency, exhibit greater viability post-nucleofection, display a more desirable cell phenotype, and/or greater/faster expansion upon addition of expansion technologies.

T cell culture media may include a commercially-available cell growth media. Exemplary commercially-available cell growth media include, but are not limited to, PBS, HBSS, OptiMEM, DMEM, RPMI 1640, AIM-V, X-VIVO 15, CellGro DC Medium, CTS OpTimizer T Cell Expansion SFM, TexMACS Medium, PRIME-XV T Cell Expansion Medium, ImmunoCult-XF T Cell Expansion Medium, or any combination thereof.

T cell compositions, T cell product compositions, unstimulated T cell compositions, resting T cell compositions or any portion thereof may be prepared for genetic modification. Preparation of T cell compositions, T cell product compositions, unstimulated T cell compositions, resting T cell compositions or any portion thereof for genetic modification may include cell washing and/or resuspension in a desired nucleofection buffer. Cryopreserved T-cell compositions may be thawed and prepared for genetic modification by nucleofection. Cryopreserved cells may be thawed according to standard or known protocols. Thawing and preparation of cryopreserved cells may be optimized to yield cells that have greater viability, nucleofect with higher efficiency, exhibit greater viability post-nucleofection, display a more desirable cell phenotype, and/or greater/faster expansion upon addition of expansion technologies. For example, Grifols Albutein (25% human albumin) may be used in the thawing and/or preparation process.

Genetic Modification of an Autologous T Cell Product Composition

T cell compositions, T cell product compositions, unstimulated T cell compositions, resting T cell compositions or any portion thereof may be genetically modified using, for example, a nucleofection strategy such as electroporation. The total number of cells to be nucleofected, the total volume of the nucleofection reaction, and the precise timing of the preparation of the sample may be optimized to yield cells that have greater viability, nucleofect with higher efficiency, exhibit greater viability post-nucleofection, display a more desirable cell phenotype, and/or greater/faster expansion upon addition of expansion technologies.

Nucleofection and/or electroporation may be accomplished using, for example. Lonza Amaxa, MaxCyte PulseAgile, Harvard Apparatus BTX, and/or Invitrogen Neon. Non-metal electrode systems, including, but not limited to, plastic polymer electrodes, may be preferred for nucleofection.

Prior to genetic modification by nucleofection. T cell compositions, T cell product compositions, unstimulated T cell compositions, resting T cell compositions or any portion thereof may be resuspended in a nucleofection buffer. Nucleofection buffers of the disclosure include commercially-available nucleofection buffers. Nucleofection buffers of the disclosure may be optimized to yield cells that have greater viability, nucleofect with higher efficiency, exhibit greater viability post-nucleofection, display a more desirable cell phenotype, and/or greater/faster expansion upon addition of expansion technologies. Nucleofection buffers of the disclosure may include, but are not limited to, PBS, HBSS, OptiMEM, BTXpress. Amaxa Nucleofector. Human T cell nucleofection buffer and any combination thereof. Nucleofection buffers of the disclosure may comprise one or more supplemental factors to yield cells that have greater viability, nucleofect with higher efficiency, exhibit greater viability post-nucleofection, display a more desirable cell phenotype, and/or greater/faster expansion upon addition of expansion technologies. Exemplary supplemental factors include, but are not limited to, recombinant human cytokines, chemokines, interleukins and any combination thereof. Exemplary cytokines, chemokines, and interleukins include, but are not limited to, IL2, IL7, IL12, IL15, IL21, IL1, IL3, IL4, IL5, IL6, IL8, CXCL8, IL9, IL10, IL11, IL13, IL14, IL16, IL17, IL18, IL19, IL20, IL22, IL23, IL25, IL26, IL27, IL28, IL29, IL30, IL31, IL32, IL33, IL35, IL36, GM-CSF, IFN-gamma, IL-1 alpha/IL-1F1, IL-1 beta/IL-1F2, IL-12 p70, IL-12/IL-35 p35, IL-13, IL-17/IL-17A, IL-17A/F Heterodimer, IL-17F, IL-18/IL-1F4, IL-23, IL-24, IL-32, IL-32 beta, IL-32 gamma, IL-33, LAP (TGF-beta 1), Lymphotoxin-alpha/TNF-beta, TGF-beta, TNF-alpha, TRANCE/TNFSF11/RANK L and any combination thereof. Exemplary supplemental factors include, but are not limited to, salts, minerals, metabolites or any combination thereof. Exemplary salts, minerals, and metabolites include, but are not limited to, HEPES, Nicotinamide, Heparin, Sodium Pyruvate, L-Glutamine, MEM Non-Essential Amino Acid Solution, Ascorbic Acid, Nucleosides, FBS/FCS, Human serum, serum-substitute, anti-biotics, pH adjusters, Earle's Salts, 2-Mercaptoethanol, Human transferrin, Recombinant human insulin, Human serum albumin, Nucleofector PLUS Supplement, KCL, MgCl2, Na2HPO4, NAH2PO4, Sodium lactobionate, Manitol, Sodium succinate, Sodium Chloride, ClNa, Glucose, Ca(NO3)2, Tris/HC, K2HPO4, KH2PO4, Polyethylenimine, Poly-ethylene-glycol, Poloxamer 188, Poloxamer 181, Poloxamer407, Poly-vinylpyrrolidone, Pop313, Crown-5, and any combination thereof. Exemplary supplemental factors include, but are not limited to, media such as PBS, HBSS, OptiMEM, DMEM, RPMI 1640, AIM-V, X-VIVO 15, CellGro DC Medium, CTS OpTimizer T Cell Expansion SFM, TexMACS Medium, PRIME-XV T Cell Expansion Medium ImmunoCult-XF T Cell Expansion Medium and any combination thereof. Exemplary supplemental factors include, but are not limited to, inhibitors of cellular DNA sensing, metabolism, differentiation, signal transduction, the apoptotic pathway and combinations thereof. Exemplary inhibitors include, but are not limited to, inhibitors of TLR9, MyD88, IRAK, TRAF6, TRAF3, IRF-7, NF-KB, Type 1 Interferons, pro-inflammatory cytokines, cGAS, STING, Sec5, TBK1, IRF-3, RNA pol III, RIG-1, IPS-1, FADD, RIP1, TRAF3, AIM2, ASC, Caspasel, Pro-L1B, PI3K, Akt, Wnt3A, inhibitors of glycogen synthase kinase-30 (GSK-3 β) (e.g. TWS119), Bafilomycin, Chloroquine. Quinacrine, AC-YVAD-CMK, Z-VAD-FMK, Z-ETD-FMK and any combination thereof. Exemplary supplemental factors include, but are not limited to, reagents that modify or stabilize one or more nucleic acids in a way to enhance cellular delivery, enhance nuclear delivery or transport, enhance the facilitated transport of nucleic acid into the nucleus, enhance degradation of epi-chromosomal nucleic acid, and/or decrease DNA-mediated toxicity. Exemplary reagents that modify or stabilize one or more nucleic acids include, but are not limited to, pH modifiers, DNA-binding proteins, lipids, phospholipids, CaPO4, net neutral charge DNA binding peptides with or without NLS sequences. TREX1 enzyme, and any combination thereof.

Transposition reagents, including a transposon and a transposase, may be added to a nucleofection reaction of the disclosure prior to, simultaneously with, or after an addition of cells to a nucleofection buffer (optionally, contained within a nucleofection reaction vial or cuvette). Transposons of the disclosure may comprise plasmid DNA, nanoplasmid, linearized plasmid DNA, a PCR product, DOGGYBONE™ DNA, an mRNA template, a single or double-stranded DNA, a protein-nucleic acid combination or any combination thereof. Transposons of the disclosure may comprised one or more sequences that encode one or more TTAA site(s), one or more inverted terminal repeat(s)(ITRs), one or more long terminal repeat(s) (LTRs), one or more insulator(s), one or more promotor(s), one or more full-length or truncated gene(s), one or more polyA signal(s), one or more self-cleaving 2A peptide cleavage site(s), one or more internal ribosome entry site(s) (IRES), one or more enhancer(s), one or more regulator(s), one or more replication origin(s), and any combination thereof.

Transposons of the disclosure may comprise one or more sequences that encode one or more full-length or truncated gene(s). Full-length and/or truncated gene(s) introduced by transposons of the disclosure may encode one or more of a signal peptide, a Centyrin, a single chain variable fragment (scFv), a hinge, a transmembrane domain, a costimulatory domain, a chimeric antigen receptor (CAR), a chimeric T-cell receptor (CAR-T), a CARTyrin (a CAR-T comprising a Centyrin), a receptor, a ligand, a cytokine, a drug resistance gene, a tumor antigen, an allo or auto antigen, an enzyme, a protein, a peptide, a poly-peptide, a fluorescent protein, a mutein or any combination thereof.

Transposons of the disclosure may be prepared in water, TAE, TBE, PBS, HBSS, media, a supplemental factor of the disclosure or any combination thereof.

Transposons of the disclosure may be designed to optimize clinical safety and/or improve manufacturability. As a non-limiting example, transposons of the disclosure may be designed to optimize clinical safety and/or improve manufacturability by eliminating unnecessary sequences or regions and/or including a non-antibiotic selection marker. Transposons of the disclosure may or may not be GMP grade.

Transposase enzymes of the disclosure may be encoded by one or more sequences of plasmid DNA, nanoplasmid DNA, mRNA, protein, protein-nucleic acid combination or any combination thereof.

Transposase enzymes of the disclosure may be prepared in water. TAE, TBE, PBS, HBSS, media, a supplemental factor of the disclosure or any combination thereof. Transposase enzymes of the disclosure or the sequences/constructs encoding or delivering them may or may not be GMP grade.

Transposons and transposase enzymes of the disclosure may be delivered to a cell by am means.

Although compositions and methods of the disclosure include delivery of a transposon and/or transposase of the disclosure to a cell by plasmid DNA (pDNA) or nanoplasmid DNA, the use of a plasmid or a nanoplasmid for delivery may allow the transposon and/or transposase to be integrated into the chromosomal DNA of the cell, which may lead to continued transposase expression. Accordingly, transposon and/or transposase enzymes of the disclosure may be delivered to a cell as either mRNA or protein to remove any possibility for chromosomal integration.

Transposons and transposases of the disclosure may be pre-incubated alone or in combination with one another prior to the introduction of the transposon and/or transposase into a nucleofection reaction. The absolute amounts of each of the transposon and the transposase, as well as the relative amounts, e.g., a ratio of transposon to transposase may be optimized.

Following preparation of nucleofection reaction, optionally, in a vial or cuvette, the reaction may be loaded into a nucleofector apparatus and activated for delivery of an electric pulse according to the manufacturer's protocol. Electric pulse conditions used for delivery of a transposon and/or a transposase of the disclosure (or a sequence encoding a transposon and/or a transposase of the disclosure) to a cell may be optimized for yielding cells with enhanced viability, higher nucleofection efficiency, greater viability post-nucleofection, desirable cell phenotype, and/or greater/faster expansion upon addition of expansion technologies. When using Amaxa nucleofector technology, each of the various nucleofection programs for the Amaxa 2B or 4D nucleofector are contemplated.

Following a nucleofection reaction of the disclosure, cells may be gently added to a cell medium. For example, when T cells undergo the nucleofection reaction, the T cells may be added to a T cell medium. Post-nucleofection cell media of the disclosure may comprise any one or more commercially-available media. Post-nucleofection cell media of the disclosure (including post-nucleofection T cell media of the disclosure) may be optimized to yield cells with greater viability, higher nucleofection efficiency, exhibit greater viability post-nucleofection, display a more desirable cell phenotype, and/or greater/faster expansion upon addition of expansion technologies. Post-nucleofection cell media of the disclosure (including post-nucleofection T cell media of the disclosure) may comprise PBS, HBSS, OptiMEM, DMEM, RPMI 1640, AIM-V, X-VIVO 15, CellGro DC Medium, CTS OpTimizer T Cell Expansion SFM, TexMACS Medium. PRIME-XV T Cell Expansion Medium, ImmunoCult-XF T Cell Expansion Medium and any combination thereof. Post-nucleofection cell media of the disclosure (including post-nucleofection T cell media of the disclosure) may comprise one or more supplemental factors of the disclosure to enhance viability, nucleofection efficiency, viability post-nucleofection, cell phenotype, and/or greater/faster expansion upon addition of expansion technologies. Exemplary supplemental factors include, but are not limited to, recombinant human cytokines, chemokines, interleukins and any combination thereof. Exemplary cytokines, chemokines, and interleukins include, but are not limited to, IL2, IL7, IL12, IL15, IL21, IL1, IL3, IL4, IL5, IL6, IL8, CXCL8, IL9, IL10, IL11, IL13, IL14, IL16, IL17, IL18, IL19, IL20, IL22, IL23. IL25, IL26, IL27, IL28, 1L29, IL30, IL31, IL32, IL33, IL35, IL36, GM-CSF, IFN-gamma, IL-1 alpha/IL-1F1, IL-1 beta IL-1F2, IL-12 p70, IL-12/IL-35 p35, IL-13, IL-17, IL-17A, IL-17A/F Heterodimer, IL-17F, IL-18/IL- 1F4, IL-23, IL-24, IL-32, IL-32 beta, IL-32 gamma, IL-33, LAP (TGF-beta 1), Lymphotoxin-alpha-TNF-beta, TGF-beta, TNF-alpha. TRANCE/TNFSF11/RANK L and any combination thereof. Exemplary supplemental factors include, but are not limited to, salts, minerals, metabolites or any combination thereof. Exemplary salts, minerals, and metabolites include, but are not limited to, HEPES, Nicotinamide, Heparin, Sodium Pyruvate, L-Glutamine, MEM Non-Essential Amino Acid Solution, Ascorbic Acid, Nucleosides, FBS/FCS, Human serum, serum-substitute, anti-biotics, pH adjusters, Earle's Salts, 2-Mercaptoethanol, Human transferrin, Recombinant human insulin, Human serum albumin, Nucleofector PLUS Supplement, KCL, MgCl2, Na2HPO4, NAH2PO4, Sodium lactobionate, Manitol, Sodium succinate, Sodium Chloride. ClNa, Glucose, Ca(NO3)2, Tris/HCl, K2HPO4, KH2PO4, Polyethylenimine, Poly-ethylene-glycol, Poloxamer 188, Poloxamer 181, Poloxamer 407, Poly-vinylpyrrolidone, Pop313, Crown-5, and any combination thereof. Exemplary supplemental factors include, but are not limited to, media such as PBS, HBSS, OptiMEM, DMEM, RPMI 1640, AIM-V, X-VIVO 15, CellGro DC Medium, CTS OpTimizer T Cell Expansion SFM. TexMACS Medium, PRIME-XV T Cell Expansion Medium, ImmunoCult-XF T Cell Expansion Medium and any combination thereof. Exemplary supplemental factors include, but are not limited to, inhibitors of cellular DNA sensing, metabolism, differentiation, signal transduction, the apoptotic pathway and combinations thereof. Exemplary inhibitors include, but are not limited to, inhibitors of TLR9, MyD88, IRAK, TRAF6, TRAF3, IRF-7, NF-KB, Type 1 Interferons, pro-inflammatory cytokines, cGAS, STING, Sec5, TBK1, IRF-3, RNA pol III, RIG-1, IPS-1, FADD, RIP1, TRAF3, AIM2, ASC, Caspasel, Pro-IL1B, PI3K, Akt, Wnt3A, inhibitors of glycogen synthase kinase-3β(GSK-3 β) (e.g. TWS119), Bafilomycin, Chloroquine, Quinacrine, AC-YVAD-CMK, Z-VAD-FMK, Z-IETD-FMK and any combination thereof. Exemplary supplemental factors include, but are not limited to, reagents that modify or stabilize one or more nucleic acids in a way to enhance cellular delivery, enhance nuclear delivery or transport, enhance the facilitated transport of nucleic acid into the nucleus, enhance degradation of epi-chromosomal nucleic acid, and/or decrease DNA-mediated toxicity. Exemplary reagents that modify or stabilize one or more nucleic acids include, but are not limited to, pH modifiers, DNA-binding proteins, lipids, phospholipids, CaPO4, net neutral charge DNA binding peptides with or without NLS sequences, TREX1 enzyme, and any combination thereof.

Post-nucleofection cell media of the disclosure (including post-nucleofection T cell media of the disclosure) may be used at room temperature or pre-warmed to, for example to between 32° C. to 37° C., inclusive of the endpoints. Post-nucleofection cell media of the disclosure (including post-nucleofection T cell media of the disclosure) may be pre-warmed to any temperature that maintains or enhances cell viability and/or expression of a transposon or portion thereof of the disclosure.

Post-nucleofection cell media of the disclosure (including post-nucleofection T cell media of the disclosure) may be contained in tissue culture flasks or dishes, G-Rex flasks. Bioreactor or cell culture bags, or any other standard receptacle. Post-nucleofection cell cultures of the disclosure (including post-nucleofection T cell cultures of the disclosure) may be may be kept still, or, alternatively, they may be perturbed (e.g. rocked, swirled, or shaken).

Post-nucleofection cell cultures may comprise genetically-modified cells Post-nucleofection T cell cultures may comprise genetically-modified T cells. Genetically modified cells of the disclosure may be either rested for a defined period of time or stimulated for expansion by, for example, the addition of a T Cell Expander technology. In certain embodiments, genetically modified cells of the disclosure may be either rested for a defined period of time or immediately stimulated for expansion by, for example, the addition of a T Cell Expander technology. Genetically modified cells of the disclosure may be rested to allow them sufficient time to acclimate, time for transposition to occur, and/or time for positive or negative selection, resulting in cells with enhanced viability, higher nucleofection efficiency, greater viability post-nucleofection, desirable cell phenotype, and/or greater/faster expansion upon addition of expansion technologies. Genetically modified cells of the disclosure may be rested, for example, for 1, 2, 3, 4, 5, 6, 7, 8, 9, 10, 11, 12, 13, 14, 15, 16, 17, 18, 19, 20, 21, 22, 23, 24, or more hours. In certain embodiments, genetically modified cells of the disclosure may be rested, for example, for an overnight. In certain aspects, an overnight is about 12 hours. Genetically modified cells of the disclosure may be rested, for example, for 1, 2, 3, 4, 5, 6, 7, 8, 9, 10, 11, 12, 13, 14 or more days.

Genetically modified cells of the disclosure may be selected following a nucleofection reaction and prior to addition of an expander technology. For optimal selection of genetically-modified cells, the cells may be allowed to rest in a post-nucleofection cell medium for at least 2-14 days to facilitate identification of modified cells (e.g., differentiation of modified from non-modified cells).

As early as 24-hours post-nucleofection, expression of a CAR/CARTyrin and selection marker of the disclosure may be detectable in modified T cells upon successful nucleofection of a transposon of the disclosure. Due to epi-chromosomal expression of the transposon, expression of a selection marker alone may not differentiate modified T cells (those cells in which the transposon has been successfully integrated) from unmodified T cells (those cells in which the transposon was not successfully integrated). When epi-chromosomal expression of the transposon obscures the detection of modified cells by the selection marker, the nucleofected cells (both modified and unmodified cells) may be rested for a period of time (e.g. 2-14 days) to allow the cells to cease expression or lose all epi-chromosomal transposon expression. Following this extended resting period, only modified T cells should remain positive for expression of selection marker. The length of this extended resting period may be optimized for each nucleofection reaction and selection process. When epi-chromosomal expression of the transposon obscures the detection of modified cells by the selection marker, selection may be performed without this extended resting period, however, an additional selection step may be included at a later time point (e.g. either during or after the expansion stage).

Selection of genetically modified cells of the disclosure may be performed by any means. In certain embodiments of the methods of the disclosure, selection of genetically modified cells of the disclosure may be performed by isolating cells expressing a specific selection marker. Selection markers of the disclosure may be encoded by one or more sequences in the transposon. Selection markers of the disclosure may be expressed by the modified cell as a result of successful transposition (i.e., not encoded by one or more sequences in the transposon). In certain embodiments, genetically modified cells of the disclosure contain a selection marker that confers resistance to a deleterious compound of the post-nucleofection cell medium. The deleterious compound may comprise, for example, an antibiotic or a drug that, absent the resistance conferred by the selection marker to the modified cells, would result in cell death. Exemplary selection markers include, but are not limited to, wild type (WT) or mutant forms of one or more of the following genes: neo, DHFR, TYMS, ALDH, MDR1, MGMT, FANCF, RAD51C, GCS, and NKX2.2. Exemplary selection markers include, but are not limited to, a surface-expressed selection marker or surface-expressed tag may be targeted by Ab-coated magnetic bead technology or column selection, respectively. A cleavable tag such as those used in protein purification may be added to a selection marker of the disclosure for efficient column selection, washing, and elution. In certain embodiments, selection markers of the disclosure are not expressed by the modified cells (including modified T cells) endogenously and, therefore, may be useful in the physical isolation of modified cells (by, for example, cell sorting techniques). Exemplary selection markers of the disclosure are not expressed by the modified cells (including modified T cells) endogenously include, but are not limited to, full-length, mutated, or truncated forms of CD271, CD19 CD52, CD34, RQR8, CD22, CD20, CD33 and any combination thereof.

Genetically modified cells of the disclosure may be selective expanded following a nucleofection reaction. In certain embodiments, modified T cells comprising a CAR/CAR-Tyrin may be selectively expanded by CAR/CARTyrin stimulation. Modified T cells comprising a CAR/CARTyrin may be stimulated by contact with a target-covered reagent (e.g. a tumor line or a normal cell line expressing a target or expander beads covered in a target). Alternatively, modified T cells comprising a CAR/CARTyrin may be stimulated by contact with an irradiated tumor cell, an irradiated allogeneic normal cell, an irradiated autologous PBMC. To minimize contamination of cell product compositions of the disclosure with a target-expressing cell used for stimulation, for example, when the cell product composition may be administered directly to a subject, the stimulation may be performed using expander beads coated with CAR/CARTyrin target protein. Selective expansion of modified T cells comprising a CAR/CARTyrin by CAR/CARTyrin stimulation may be optimized to avoid functionally-exhausting the modified T-cells.

Selected genetically-modified cells of the disclosure may be cryopreserved, rested for a defined period of time, or stimulated for expansion by the addition of a Cell Expander technology. Selected genetically-modified cells of the disclosure may be cryopreserved, rested for a defined period of time, or immediately stimulated for expansion by the addition of a Cell Expander technology. When the selected genetically-modified cells are T cells, the T cells may be stimulated for expansion by the addition of a T-Cell Expander technology. Selected genetically modified cells of the disclosure may be rested, for example, for 1, 2, 3, 4, 5, 6, 7, 8, 9, 10, 11, 12, 13, 14, 15, 16, 17, 18, 19, 20, 21, 22, 23, 24, or more hours. In certain embodiments, selected genetically modified cells of the disclosure may be rested, for example, for an overnight. In certain aspects, an overnight is about 12 hours. Selected genetically modified cells of the disclosure may be rested, for example, for 1, 2, 3, 4, 5, 6, 7, 8, 9, 10, 11, 12, 13, 14 or more days. Selected genetically modified cells of the disclosure may be rested for any period of time resulting in cells with enhanced viability, higher nucleofection efficiency, greater viability post-nucleofection, desirable cell phenotype, and/or greater/faster expansion upon addition of expansion technologies.

Selected genetically-modified cells (including selected genetically-modified T cells of the disclosure) may be cryopreserved using any standard cryopreservation method, which may be optimized for storing and/or recovering human cells with high recovery, viability, phenotype, and/or functional capacity. Cryopreservation methods of the disclosure may include commercially-available cryopreservation media and/or protocols.

A transposition efficiency of selected genetically-modified cells (including selected genetically-modified T cells of the disclosure) may be assessed by any means. For example, prior to the application of an expander technology, expression of the transposon by selected genetically-modified cells (including selected genetically-modified T cells of the disclosure) may be measured by fluorescence-activated cell sorting (FACS). Determination of a transposition efficiency of selected genetically-modified cells (including selected genetically-modified T cells of the disclosure) may include determining a percentage of selected cells expressing the transposon (e.g. a CAR). Alternatively, or in addition, a purity of T cells, a Mean Fluorescence Intensity (MFI) of the transposon expression (e.g. CAR expression), an ability of a CAR (delivered in the transposon) to mediate degranulation and/or killing of a target cell expressing the CAR ligand, and/or a phenotype of selected genetical-modified cells (including selected genetically-modified T cells of the disclosure) may be assessed by any means.

Cell product compositions of the disclosure may be released for administration to a subject upon meeting certain release criteria Exemplary release criteria may include, but are not limited to, a particular percentage of modified, selected and/or expanded T cells expressing detectable levels of a CAR on the cell surface.

Genetic Modification of an Autologous T Cell Product Composition

Genetically-modified cells (including genetically-modified T cells) of the disclosure may be expanded using an expander technology. Expander technologies of the disclosure may comprise a commercially-available expander technology. Exemplary expander technologies of the disclosure include stimulation a genetically-modified T cell of the disclosure via the TCR While all means for stimulation of a genetically-modified T cell of the disclosure are contemplated, stimulation a genetically-modified T cell of the disclosure via the TCR is a preferred method, yielding a product with a superior level of killing capacity.

To stimulate a genetically-modified T cell of the disclosure via the TCR, Thermo Expander DynaBeads may be used at a 3:1 bead to T cell ratio. If the expander beads are not biodegradable, the beads may be removed from the expander composition. For example, the beads may be removed from the expander composition after about 5 days. To stimulate a genetically-modified T cell of the disclosure via the TCR, a Miltenyi T Cell Activation/Expansion Reagent may be used. To stimulate a genetically-modified T cell of the disclosure via the TCR, StemCell Technologies' ImmunoCult Human CD3/CD28 or CD3/CD28/CD2 T Cell Activator Reagent may be used. This technology may be preferred since the soluble tetrameric antibody complexes would degrade after a period and would not require removal from the process.

Artificial antigen presenting cells (APCs) may be engineered to co-express the target antigen and may be used to stimulate a cell or T-cell of the disclosure through a TCR and/or CAR of the disclosure. Artificial APCs may comprise or may be derived from a tumor cell line (including, for example, the immortalized myelogenous leukemia line K562) and may be engineered to co-express multiple costimulatory molecules or technologies (such as CD28, 4-1BBL, CD64, mbIL-21, mbIL-15, CAR target molecule, etc.). When artificial APCs of the disclosure are combined with costimulatory molecules, conditions may be optimized to prevent the development or emergence of an undesirable phenotype and functional capacity, namely terminally-differentiated effector T cells.

Irradiated PBMCs (auto or allo) may express some target antigens, such as CD19, and may be used to stimulate a cell or T-cell of the disclosure through a TCR and/or CAR of the disclosure. Alternatively, or in addition, irradiated tumor cells may express some target antigens and may be used to stimulate a cell or T-cell of the disclosure through a TCR and/or CAR of the disclosure.

Plate-bound and/or soluble anti-CD3, anti-CD2 and/or anti-CD28 stimulate may be used to stimulate a cell or T-cell of the disclosure through a TCR and/or CAR of the disclosure.

Antigen-coated beads may display target protein and may be used to stimulate a cell or T-cell of the disclosure through a TCR and/or CAR of the disclosure. Alternatively, or in addition, expander beads coated with a CAR/CARTyrin target protein may be used to stimulate a cell or T-cell of the disclosure through a TCR and/or CAR of the disclosure.

Expansion methods drawn to stimulation of a cell or T-cell of the disclosure through the TCR or CAR/CARTyrin and via surface-expressed CD2, CD3, CD28, 4-1BB, and/or other markers on genetically-modified T cells.

An expansion technology may be applied to a cell of the disclosure immediately post-nucleofection until approximately 24 hours post-nucleofection. While various cell media may be used during an expansion procedure, a desirable T Cell Expansion Media of the disclosure may yield cells with, for example, greater viability, cell phenotype, total expansion, or greater capacity for in vivo persistence, engraftment, and/or CAR-mediated killing. Cell media of the disclosure may be optimized to improve/enhance expansion, phenotype, and function of genetically-modified cells of the disclosure. A preferred phenotype of expanded T cells may include a mixture of T stem cell memory, T central, and T effector memory cells. Expander Dynabeads may yield mainly central memory T cells which may lead to superior performance in the clinic.

Exemplary T cell expansion media of the disclosure may include, in part or in total, PBS, HBSS, OptiMEM, DMEM, RPMI 1640, AIM-V, X-VIVO 15, CellGro DC Medium. CTS OpTimizer T Cell Expansion SFM. TexMACS Medium, PRIME-XV T Cell Expansion Medium, ImmunoCult-XF T Cell Expansion Medium, or any combination thereof. T cell expansion media of the disclosure may further include one or more supplemental factors. Supplemental factors that may be included in a T cell expansion media of the disclosure enhance viability, cell phenotype, total expansion, or increase capacity for in vivo persistence, engraftment, and/or CAR-mediated killing. Supplemental factors that may be included in a T cell expansion media of the disclosure include, but are not limited to, recombinant human cytokines, chemokines, and/or interleukins such as IL2, IL7, IL12, IL15, IL21, IL1, IL3, IL4, IL5, IL6, IL8, CXCL8, IL9, IL10, IL11, IL13, IL14, IL16, IL17, IL18, IL19, IL20, IL22, IL23, IL25, IL26, IL27, IL28, IL29, IL30, IL31, IL32, IL33, IL35, IL36, GM-CSF, IFN-gamma, IL-1 alpha/IL-1F1, IL-1 beta/IL-1F2, IL-12 p70, IL-12/IL-35 p35, IL-13, IL-17/IL-17A, IL-17A/F Heterodimer, IL-17F, IL-18/IL-1F4, IL-23, IL-24, IL-32, IL-32 beta, IL-32 gamma. IL-33, LAP (TGF-beta 1), Lymphotoxin-alpha/TNF-beta, TGF-beta, TNF-alpha, TRANCE/TNFSF11/RANK L, or any combination thereof. Supplemental factors that may be included in a T cell expansion media of the disclosure include, but are not limited to, salts, minerals, and/or metabolites such as HEPES, Nicotinamide, Heparin, Sodium Pyruvate, L-Glutamine, MEM Non-Essential Amino Acid Solution, Ascorbic Acid, Nucleosides, FBS/FCS, Human serum, serum-substitute, anti-biotics, pH adjusters, Earle's Salts, 2-Mercaptoethanol, Human transferrin, Recombinant human insulin, Human serum albumin, Nucleofector PLUS Supplement, KCL, MgCl2, Na2HPO4, NAH2PO4, Sodium lactobionate, Manitol, Sodium succinate, Sodium Chloride, ClNa, Glucose, Ca(NO3)2, Tris/HC, K2HPO4, KH2PO4, Polyethylenimine, Poly-ethylene-glycol, Poloxamer 188, Poloxamer 181, Poloxamer 407, Polyvinylpyrrolidone, Pop313, Crown-5 or any combination thereof. Supplemental factors that may be included in a T cell expansion media of the disclosure include, but are not limited to, inhibitors of cellular DNA sensing, metabolism, differentiation, signal transduction, and/or the apoptotic pathway such as inhibitors of TLR9, MyD88, IRAK, TRAF6, TRAF3, IRF-7, NF-KB, Type 1 Interferons, pro-inflammatory cytokines, cGAS, STING, Sec5, TBK1, IRF-3, RNA pol III, RIG-1, IPS-1, FADD, RIP1, TRAF3, AIM2, ASC, Caspase1, Pro-IL1B, PI3K Akt, Wnt3A, inhibitors of glycogen synthase kinase-3β (GSK-3 β) (e.g. TWS119), Bafilomycin, Chloroquine, Quinacrine, AC-YVAD-CMK, Z-VAD-FMK, Z-IETD-FMK, or any combination thereof.

Supplemental factors that may be included in a T cell expansion media of the disclosure include, but are not limited to, reagents that modify or stabilize nucleic acids in a way to enhance cellular delivery, enhance nuclear delivery or transport, enhance the facilitated transport of nucleic acid into the nucleus, enhance degradation of epi-chromosomal nucleic acid, and/or decrease DNA-mediated toxicity, such as pH modifiers, DNA-binding proteins, lipids, phospholipids, CaPO4, net neutral charge DNA binding peptides with or without NLS sequences. TREX1 enzyme, or any combination thereof.

Genetically-modified cells of the disclosure may be selected during the expansion process by the use of selectable drugs or compounds. For example, in certain embodiments, when a transposon of the disclosure may encode a selection marker that confers to genetically-modified cells resistance to a drug added to the culture medium, selection may occur during the expansion process and may require approximately 1-14 days of culture for selection to occur. Examples of drug resistance genes that may be used as selection markers encoded by a transposon of the disclosure, include, but are not limited to, wild type (WT) or mutant forms of the genes neo, DHFR, TYMS, ALDH, MDR1, MGMT, FANCF, RAD51C, GCS, NKX2.2, or any combination thereof. Examples of corresponding drugs or compounds that may be added to the culture medium to which a selection marker may confer resistance include, but are not limited to, G418, Puromycin, Ampicillin, Kanamycin, Methotrexate, Mephalan, Temozolomide, Vincristine, Etoposide, Doxorubicin, Bendamustine, Fludarabine, Aredia (Pamidronate Disodium), Becenum (Carmustine), BiCNU (Carmustine), Bortezomib, Carfilzomib, Carmubris (Carmustine), Carmustine, Clafen (Cyclophosphamide), Cyclophosphamide, Cytoxan (Cyclophosphamide), Daratumumab, Darzalex (Daratumumab), Doxil (Doxorubicin Hydrochloride Liposome), Doxorubicin Hydrochloride Liposome, Dox-SL (Doxorubicin Hydrochloride Liposome), Elotuzumab, Empliciti (Elotuzumab), Evacet (Doxorubicin Hydrochloride Liposome), Farydak (Panobinostat), ixazomib Citrate, Kyprolis (Carfilzomib), Lenalidomide, LipoDox (Doxorubicin Hydrochloride Liposome), Mozobil (Plerixafor), Neosar (Cyclophosphamide), Ninlaro (Ixazomib Citrate), Pamidronate Disodium, Panobinostat, Plerixafor, Pomalidomide, Pomalyst (Pomalidomide), Revlimid (Lenalidomide), Synovir (Thalidomide), Thalidomide, Thalomid (Thalidomide), Velcade (Bortezomib), Zoledronic Acid, Zometa (Zoledronic Acid), or any combination thereof.

A T-Cell Expansion process of the disclosure may occur in a cell culture bag in a WAVE Bioreactor, a G-Rex flask, or in any other suitable container and/or reactor.

A cell or T-cell culture of the disclosure may be kept steady, rocked, swirled, or shaken.

A cell or T-cell expansion process of the disclosure may optimize certain conditions, including, but not limited to culture duration, cell concentration, schedule for T cell medium addition/removal, cell size, total cell number, cell phenotype, purity of cell population, percentage of genetically-modified cells in growing cell population, use and composition of supplements, the addition/removal of expander technologies, or any combination thereof.

A cell or T-cell expansion process of the disclosure may continue until a predefined endpoint prior to formulation of the resultant expanded cell population. For example, a cell or T-cell expansion process of the disclosure may continue for a predetermined amount of time: at least, 2, 4, 6, 8, 10, 12, 14, 16, 18, 20, 22, 24 hours; at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 days; at least 1, 2, 3, 4, 5, 6, 7, 8, 9, 10, 11, 12 weeks; at least 1, 2, 3, 4, 5, 6, months, or at least 1 year. A cell or T-cell expansion process of the disclosure may continue until the resultant culture reaches a predetermined overall cell density: 1, 10, 100, 1000, 104, 105, 106, 107, 108, 109, 1010 cells per volume (μl, ml, L) or any density in between. A cell or T-cell expansion process of the disclosure may continue until the genetically-modified cells of a resultant culture demonstrate a predetermined level of expression of a transposon of the disclosure: 1%, 10%, 20%, 30%, 40%, 50%, 60%, 70%, 80%, 90%, or 100% or any percentage in between of a threshold level of expression (a minimum, maximum or mean level of expression indicating the resultant genetically-modified cells are clinically-efficacious). A cell or T-cell expansion process of the disclosure may continue until the proportion of genetically-modified cells of a resultant culture to the proportion of unmodified cells reaches a predetermined threshold: at least 1:10, 1:9, 1:8, 1:7, 1:6, 1:5, 1:4, 1:3, 1:2, 1:1, 2:1, 2:1, 4:1, 5:1, 6:1, 7:1, 8:1, 9:1 10:1 or any ratio in between.

Analysis of Genetically-Modified Autologous T Cells for Release

A percentage of genetically-modified cells may be assessed during or after an expansion process of the disclosure. Cellular expression of a transposon by a genetically-modified cell of the disclosure may be measured by fluorescence-activated cell sorting (FACS) For example, FACS may be used to determine a percentage of cells or T cells expressing a CAR of the disclosure. Alternatively, or in addition, a purity of genetically-modified cells or T cells, the Mean Fluorescence Intensity (MFI) of a CAR expressed by a genetically-modified cell or T cell of the disclosure, an ability of the CAR to mediate degranulation and/or killing of a target cell expressing the CAR ligand, and/or a phenotype of CAR+ T cells may be assessed.

Compositions of the disclosure intended for administration to a subject may be required to meet one or more "release criteria" that indicate that the composition is safe and efficacious for formulation as a pharmaceutical product and/or administration to a subject. Release criteria may include a requirement that a composition of the disclosure (e.g. a T-cell product of the disclosure) comprises a particular percentage of T cells expressing detectable levels of a CAR of the disclosure on their cell surface.

The expansion process should be continued until a specific criterion has been met (e.g. achieving a certain total number of cells, achieving a particular population of memory cells, achieving a population of a specific size).

Certain criterion signal a point at which the expansion process should end. For example, cells should be formulated, reactivated, or cryopreserved once they reach a cell size of 300 fL (otherwise, cells reaching a size above this threshold may start to die). Cryopreservation immediately once a population of cells reaches an average cell size of less than 300 fL may yield better cell recovery upon thawing and culture because the cells haven't yet reached a fully quiescent state prior to cryopreservation (a fully quiescent size is approximately 180 fL). Prior to expansion, T cells of the disclosure may have a cell size of about 180 f, but may more than quadruple their cell size to approximately 900 fL at 3 days post-expansion. Over the next 6-12 days, the population of T-cells will slowly decrease cell size to full quiescence at 180 f.

A process for preparing a cell population for formulation may include, but is not limited to the steps of, concentrating the cells of the cell population, washing the cells, and/or further selection of the cells via drug resistance or magnetic bead sorting against a particular surface-expressed marker. A process for preparing a cell population for formulation may further include a sorting step to ensure the safety and purity of the final product. For example, if a tumor cell from a patient has been used to stimulate a genetically-modified T-cell of the disclosure or that have been genetically-modified in order to stimulate a genetically-modified T-cell of the disclosure that is being prepared for formulation, it is critical that no tumor cells from the patient are included in the final product.

Cell Product Infusion and/or Cryopreservation for Infusion

A pharmaceutical formulation of the disclosure may be distributed into bags for infusion, cryopreservation, and/or storage.

A pharmaceutical formulation of the disclosure may be cryopreserved using a standard protocol and, optionally, an infusible cryopreservation medium. For example, a DMSO free cryopreservant (e.g. CryoSOfree™, DMSO-free Cryopreservation Medium) may be used to reduce freezing-related toxicity. A cryopreserved pharmaceutical formulation of the disclosure may be stored for infusion to a patient at a later date. An effective treatment may require multiple administrations of a pharmaceutical formulation of the disclosure and, therefore, pharmaceutical formulations may be packaged in pre-aliquoted "doses" that may be stored frozen but separated for thawing of individual doses.

A pharmaceutical formulation of the disclosure may be stored at room temperature. An effective treatment may require multiple administrations of a pharmaceutical formulation of the disclosure and, therefore, pharmaceutical formulations may be packaged in pre-aliquoted "doses" that may be stored together but separated for administration of individual doses.

A pharmaceutical formulation of the disclosure may be archived for subsequent re-expansion and/or selection for generation of additional doses to the same patient in the case of an allogenic therapy who may need an administration at a future date following, for example, a remission and relapse of a condition.

Formulations

As noted above, the disclosure provides for stable formulations, which preferably comprise a phosphate buffer with saline or a chosen salt, as well as preserved solutions and formulations containing a preservative as well as multi-use preserved formulations suitable for pharmaceutical or veterinary use, comprising at least one protein scaffold in a pharmaceutically acceptable formulation. Preserved formulations contain at least one known preservative or optionally selected from the group consisting of at least one phenol, m-cresol, p-cresol, o-cresol, chlorocresol, benzyl alcohol, phenylmercuric nitrite, phenoxyethanol, formaldehyde, chlorobutanol, magnesium chloride (e.g., hexahydrate), alkylparaben (methyl, ethyl, propyl, butyl and the like), benzalkonium chloride, benzethonium chloride, sodium dehydroacetate and thimerosal, polymers, or mixtures thereof in an aqueous diluent. Any suitable concentration or mixture can be used as known in the art, such as about 0.0015%, or any range, value, or fraction therein. Non-limiting examples include, no preservative, about 0.1-2% m-cresol (e.g., 0.2, 0.3, 0.4, 0.5, 0.9, 1.0%), about 0.1-3% benzyl alcohol (e.g., 0.5, 0.9, 1.1, 1.5, 1.9, 2.0, 2.5%), about 0.001-0.5% thimerosal (e.g., 0.005, 0.01), about 0.001-2.0% phenol (e.g., 0.05, 0.25, 0.28, 0.5, 0.9, 1.0%), 0.0005-1.0% alkylparaben(s) (e.g., 0.00075, 0.0009, 0.001, 0.002, 0.005, 0.0075, 0.009, 0.01, 02.0.05, 0.075, 0.09, 0.1, 0.2, 0.3, 0.5, 0.75, 0.9, 1.0%), and the like.

As noted above, the invention provides an article of manufacture, comprising packaging material and at least one vial comprising a solution of at least one protein scaffold with the prescribed buffers and/or preservatives, optionally in an aqueous diluent, wherein said packaging material comprises a label that indicates that such solution can be held over a period of 1, 2, 3, 4, 5, 6, 9, 12, 18, 20, 24, 30, 36, 40, 48, 54, 60, 66, 72 hours or greater. The invention further comprises an article of manufacture, comprising packaging material, a first vial comprising lyophilized at least one protein scaffold, and a second vial comprising an aqueous diluent of prescribed buffer or preservative, wherein said packaging material comprises a label that instructs a patient to reconstitute the at least one protein scaffold in the aqueous diluent to form a solution that can be held over a period of twenty-four hours or greater.

The at least one protein scaffold used in accordance with the present invention can be produced by recombinant means, including from mammalian cell or transgenic preparations, or can be purified from other biological sources, as described herein or as known in the art.

The range of at least one protein scaffold in the product of the present invention includes amounts yielding upon reconstitution, if in a wet/dry system, concentrations from about 1.0 µg/ml to about 1000 mg/ml, although lower and higher concentrations are operable and are dependent on the intended delivery vehicle, e.g., solution formulations will differ from transdermal patch, pulmonary, transmucosal, or osmotic or micro pump methods.

Preferably, the aqueous diluent optionally further comprises a pharmaceutically acceptable preservative. Preferred preservatives include those selected from the group consisting of phenol, m-cresol, p-cresol, o-cresol, chlorocresol, benzyl alcohol, alkylparaben (methyl, ethyl, propyl, butyl and the like), benzalkonium chloride, benzethonium chloride, sodium dehydroacetate and thimerosal, or mixtures thereof. The concentration of preservative used in the formulation is a concentration sufficient to yield an anti-microbial effect. Such concentrations are dependent on the preservative selected and are readily determined by the skilled artisan.

Other excipients, e.g., isotonicity agents, buffers, antioxidants, and preservative enhancers, can be optionally and preferably added to the diluent. An isotonicity agent, such as glycerin, is commonly used at known concentrations. A physiologically tolerated buffer is preferably added to provide improved pH control. The formulations can cover a wide range of pHs, such as from about pH 4 to about pH 10, and preferred ranges from about pH 5 to about pH 9, and a most preferred range of about 6.0 to about 8.0. Preferably, the formulations of the present invention have a pH between about 6.8 and about 7.8. Preferred buffers include phosphate buffers, most preferably, sodium phosphate, particularly, phosphate buffered saline (PBS).

Other additives, such as a pharmaceutically acceptable solubilizers like Tween 20 (polyoxyethylene (20) sorbitan monolaurate), Tween 40 (polyoxyethylene (20) sorbitan monopalmitate), Tween 80 (polyoxyethylene (20) sorbitan monooleate), Pluronic F68 (polyoxyethylene polyoxypropylene block copolymers), and PEG (polyethylene glycol) or non-ionic surfactants, such as polysorbate 20 or 80 or poloxamer 184 or 188, Pluronic® polyls, other block co-polymers, and chelators, such as EDTA and EGTA, can optionally be added to the formulations or compositions to reduce aggregation. These additives are particularly useful if a pump or plastic container is used to administer the formulation. The presence of pharmaceutically acceptable surfactant mitigates the propensity for the protein to aggregate.

The formulations of the present invention can be prepared by a process which comprises mixing at least one protein scaffold and a preservative selected from the group consisting of phenol, m-cresol, p-cresol, o-cresol, chlorocresol, benzyl alcohol, alkylparaben, (methyl, ethyl, propyl, butyl and the like), benzalkonium chloride, benzethonium chloride, sodium dehydroacetate and thimerosal or mixtures thereof in an aqueous diluent. Mixing the at least one protein scaffold and preservative in an aqueous diluent is carried out using conventional dissolution and mixing procedures. To prepare a suitable formulation, for example, a measured amount of at least one protein scaffold in buffered solution is combined with the desired preservative in a buffered solution in quantities sufficient to provide the protein and preservative at the desired concentrations. Variations of this process would be recognized by one of ordinary skill in the art. For example, the order the components are added, whether additional additives are used, the temperature and pH at which the formulation is prepared, are all factors that can be optimized for the concentration and means of administration used.

The claimed formulations can be provided to patients as clear solutions or as dual vials comprising a vial of lyophilized at least one protein scaffold that is reconstituted with a second vial containing water, a preservative and/or excipients, preferably, a phosphate buffer and/or saline and a chosen salt, in an aqueous diluent. Either a single solution vial or dual vial requiring reconstitution can be reused multiple times and can suffice for a single or multiple cycles of patient treatment and thus can provide a more convenient treatment regimen than currently available.

The present claimed articles of manufacture are useful for administration over a period ranging from immediate to twenty-four hours or greater. Accordingly, the presently claimed articles of manufacture offer significant advantages to the patient. Formulations of the invention can optionally be safely stored at temperatures of from about 2° C. to about 40° C. and retain the biological activity of the protein for extended periods of time, thus allowing a package label indicating that the solution can be held and/or used over a period of 6, 12, 18, 24, 36, 48, 72, or 96 hours or greater. If preserved diluent is used, such label can include use up to 1-12 months, one-half, one and a half, and/or two years.

The solutions of at least one protein scaffold of the invention can be prepared by a process that comprises mixing at least one protein scaffold in an aqueous diluent. Mixing is carried out using conventional dissolution and mixing procedures. To prepare a suitable diluent, for example, a measured amount of at least one protein scaffold in water or buffer is combined in quantities sufficient to provide the protein and, optionally, a preservative or buffer at the desired concentrations. Variations of this process would be recognized by one of ordinary skill in the art. For example, the order the components are added, whether additional additives are used, the temperature and pH at which the formulation is prepared, are all factors that can be optimized for the concentration and means of administration used.

The claimed products can be provided to patients as clear solutions or as dual vials comprising a vial of lyophilized at least one protein scaffold that is reconstituted with a second vial containing the aqueous diluent. Either a single solution vial or dual vial requiring reconstitution can be reused multiple times and can suffice for a single or multiple cycles of patient treatment and thus provides a more convenient treatment regimen than currently available.

The claimed products can be provided indirectly to patients by providing to pharmacies, clinics, or other such institutions and facilities, clear solutions or dual vials comprising a vial of lyophilized at least one protein scaffold that is reconstituted with a second vial containing the aqueous diluent. The clear solution in this case can be up to one liter or even larger in size, providing a large reservoir from which smaller portions of the at least one protein scaffold solution can be retrieved one or multiple times for transfer into smaller vials and provided by the pharmacy or clinic to their customers and/or patients.

Recognized devices comprising single vial systems include pen-injector devices for delivery of a solution, such as BD Pens, BD Autojector®, Humaject®, NovoPen®, B-D® Pen, AutoPen®, and OptiPen®, GenotropinPen®, Genotronorm Pen®, Humatro Pen®, Reco-Pen®, Roferon Pen®, Biojector®, Iject®, J-tip Needle-Free Injector®, Intraject®, Medi-Ject®, e.g., as made or developed by Becton Dickinson (Franklin Lakes. N.J., www.bectondickenson.com), Disetronic (Burgdorf, Switzerland, www.disetronic.com, Bioject, Portland, Oreg. (www.bioject.com); National Medical Products, Weston Medical (Peterborough, UK, www.weston-medical.com), Medi-Ject Corp (Minneapolis, Minn., www.mediject.com), and similarly suitable devices. Recognized devices comprising a dual vial system include those pen-injector systems for reconstituting a lyophilized drug in a cartridge for delivery of the reconstituted solution, such as the HumatroPen®. Examples of other devices suitable include pre-filled syringes, auto-injectors, needle free injectors and needle free IV infusion sets.

The products presently claimed include packaging material. The packaging material provides, in addition to the information required by the regulatory agencies, the conditions under which the product can be used. The packaging material of the present invention provides instructions to the patient to reconstitute at least one protein scaffold in the aqueous diluent to form a solution and to use the solution over a period of 2-24 hours or greater for the two vial, wet/dry, product. For the single vial, solution product, the label indicates that such solution can be used over a period of 2-24 hours or greater. The presently claimed products are useful for human pharmaceutical product use.

The formulations of the present invention can be prepared by a process that comprises mixing at least one protein scaffold and a selected buffer, preferably, a phosphate buffer containing saline or a chosen salt. Mixing at least one protein scaffold and buffer in an aqueous diluent is carried out using conventional dissolution and mixing procedures. To prepare a suitable formulation, for example, a measured amount of at least one protein scaffold in water or buffer is combined with the desired buffering agent in water in quantities sufficient to provide the protein and buffer at the desired concentrations. Variations of this process would be recognized by one of ordinary skill in the art. For example, the order the components are added, whether additional additives are used, the temperature and pH at which the formulation is prepared, are all factors that can be optimized for the concentration and means of administration used.

The claimed stable or preserved formulations can be provided to patients as clear solutions or as dual vials comprising a vial of lyophilized protein scaffold that is reconstituted with a second vial containing a preservative or buffer and excipients in an aqueous diluent. Either a single solution vial or dual vial requiring reconstitution can be reused multiple times and can suffice for a single or multiple cycles of patient treatment and thus provides a more convenient treatment regimen than currently available.

Other formulations or methods of stabilizing the protein scaffold may result in other than a clear solution of lyophilized powder comprising the protein scaffold. Among non-clear solutions are formulations comprising particulate suspensions, said particulates being a composition containing the protein scaffold in a structure of variable dimension and known variously as a microsphere, microparticle, nanoparticle, nanosphere, or liposome. Such relatively homogenous, essentially spherical, particulate formulations containing an active agent can be formed by contacting an aqueous phase containing the active agent and a polymer and a nonaqueous phase followed by evaporation of the nonaqueous phase to cause the coalescence of particles from the aqueous phase as taught in U.S. Pat. No. 4,589,330. Porous microparticles can be prepared using a first phase containing active agent and a polymer dispersed in a continuous solvent and removing said solvent from the suspension by freeze-drying or dilution-extraction-precipitation as taught in U.S. Pat. No. 4,818,542. Preferred polymers for such preparations are natural or synthetic copolymers or polymers selected from the group consisting of gelatin agar, starch, arabinogalactan, albumin, collagen, polyglycolic acid, polylactic aced, glycolide-L(−) lactide poly(epsilon-caprolactone, poly(epsilon-caprolactone-CO-lactic acid), poly(epsilon-caprolactone-CO-gly colic acid), poly(β-hydroxy butyric acid), polyethylene oxide, polyethylene, poly(alkyl-2-cyanoacrylate), poly(hydroxyethyl methacrylate), polyamides, poly(amino acids), poly(2-hydroxyethyl DL-aspartamide), poly(ester urea), poly(L-phenylalanine/ethylene glycol/1,6-diisocyanatohexane) and poly(methyl methacrylate). Particularly preferred polymers are polyesters, such as polyglycolic acid, polylactic aced, glycolide-L(−) lactide poly(epsilon-caprolactone, poly(epsilon-caprolactone-CO-lactic acid), and poly(epsilon-caprolactone-CO-glycolic acid. Solvents useful for dissolving the polymer and/or the active include: water, hexafluoroisopropanol, methylenechloride, tetrahydrofuran, hexane, benzene, or hexafluoroacetone sesquihydrate. The process of dispersing the active containing phase with a second phase may include pressure forcing said first phase through an orifice in a nozzle to affect droplet formation.

Dry powder formulations may result from processes other than lyophilization, such as by spray drying or solvent extraction by evaporation or by precipitation of a crystalline composition followed by one or more steps to remove aqueous or nonaqueous solvent. Preparation of a spray-dried protein scaffold preparation is taught in U.S. Pat. No. 6,019,968. The protein scaffold-based dry powder compositions may be produced by spray drying solutions or slurries of the protein scaffold and, optionally, excipients, in a solvent wider conditions to provide a respirable dry powder. Solvents may include polar compounds, such as water and ethanol, which may be readily dried. Protein scaffold stability may be enhanced by performing the spray drying procedures in the absence of oxygen, such as under a nitrogen blanket or by using nitrogen as the drying gas. Another relatively dry formulation is a dispersion of a plurality of perforated microstructures dispersed in a suspension medium that typically comprises a hydrofluoroalkane propellant as taught in WO 9916419. The stabilized dispersions may be administered to the lung of a patient using a metered dose inhaler. Equipment useful in the commercial manufacture of spray dried medicaments are manufactured by Buchi Ltd. or Niro Corp.

At least one protein scaffold in either the stable or preserved formulations or solutions described herein, can be administered to a patient in accordance with the present invention via a variety of delivery methods including SC or IM injection; transdermal, pulmonary, transmucosal, implant, osmotic pump, cartridge, micro pump, or other means appreciated by the skilled artisan, as well-known in the art.

Therapeutic Applications

The present invention also provides a method for modulating or treating a disease, in a cell, tissue, organ, animal, or patient, as known in the art or as described herein, using at least one protein scaffold of the present invention. e.g., administering or contacting the cell, tissue, organ, animal, or patient with a therapeutic effective amount of protein scaffold. The present invention also provides a method for modulating or treating a disease, in a cell, tissue, organ, animal, or patient.

Any method of the present invention can comprise administering an effective amount of a composition or pharmaceutical composition comprising at least one protein scaffold to a cell, tissue, organ, animal or patient in need of such modulation, treatment or therapy. Such a method can optionally further comprise co-administration or combination therapy for treating such diseases or disorders, wherein the administering of said at least one protein scaffold, specified portion or variant thereof, further comprises administering, before concurrently, and/or after, at least one selected from at least one of an alkylating agent, an a mitotic inhibitor, and a radiopharmaceutical. Suitable dosages are well known in the art. See, e.g., Wells et al., eds., Pharmacotherapy Handbook, 2nd Edition, Appleton and Lange, Stamford, Conn. (2000)); PDR Pharmacopoeia, Tarascon Pocket Pharmacopoeia 2000, Deluxe Edition. Tarascon Publishing, Loma Linda, Calif. (2000); Nursing 2001 Handbook of Drugs, 21st edition, Springhouse Corp., Springhouse, Pa., 2001; Health Professional's Drug Guide 2001, ed., Shannon, Wilson, Stang, Prentice-Hall, Inc, Upper Saddle River, N.J., each of which references are entirely incorporated herein by reference.

Preferred doses can optionally include about 0.1-99 and/or 100-500 mg/kg/administration, or any range, value or fraction thereof, or to achieve a serum concentration of about 0.1-5000 µg/ml serum concentration per single or multiple administration, or any range, value or fraction thereof. A preferred dosage range for the protein scaffold of the present invention is from about 1 mg/kg, up to about 3, about 6 or about 12 mg/kg of body weight of the patient.

Alternatively, the dosage administered can vary depending upon known factors, such as the pharmacodynamic characteristics of the particular agent, and its mode and route of administration, age, health, and weight of the recipient; nature and extent of symptoms, kind of concurrent treatment, frequency of treatment, and the effect desired. Usually a dosage of active ingredient can be about 0.1 to 100 milligrams per kilogram of body weight. Ordinarily 0.1 to 50, and preferably. 0.1 to 10 milligrams per kilogram per administration or in sustained release form is effective to obtain desired results.

As a non-limiting example, treatment of humans or animals can be provided as a one-time or periodic dosage of at least one protein scaffold of the present invention about 0.1 to 100 mg/kg or any range, value or fraction thereof per day, on at least one of day 1-40, or, alternatively or additionally, at least one of week 1-52, or, alternatively or additionally, at least one of 1-20 years, or any combination thereof, using single, infusion or repeated doses.

Dosage forms (composition) suitable for internal administration generally contain from about 0.001 milligram to about 500 milligrams of active ingredient per unit or container. In these pharmaceutical compositions the active ingredient will ordinarily be present in an amount of about 0.5-99.999% by weight based on the total weight of the composition.

For parenteral administration, the protein scaffold can be formulated as a solution, suspension, emulsion, particle, powder, or lyophilized powder in association, or separately provided, with a pharmaceutically acceptable parenteral vehicle. Examples of such vehicles are water, saline, Ringer's solution, dextrose solution, and about 1-10% human serum albumin. Liposomes and nonaqueous vehicles, such as fixed oils, can also be used. The vehicle or lyophilized powder can contain additives that maintain isotonicity (e.g., sodium chloride, mannitol) and chemical stability (e.g., buffers and preservatives). The formulation is sterilized by known or suitable techniques.

Suitable pharmaceutical carriers are described in the most recent edition of Remington's Pharmaceutical Sciences, A. Osol, a standard reference text in this field.

Alternative Administration

Many known and developed modes can be used according to the present invention for administering pharmaceutically effective amounts of at least one protein scaffold according to the present invention. While pulmonary administration is used in the following description, other modes of administration can be used according to the present invention with suitable results. Protein scaffolds of the present invention can be delivered in a carrier, as a solution, emulsion, colloid, or suspension, or as a dry powder, using any of a variety of devices and methods suitable for administration by inhalation or other modes described here within or known in the art.

Parenteral Formulations and Administration

Formulations for parenteral administration can contain as common excipients sterile water or saline, polyalkylene glycols, such as polyethylene glycol, oils of vegetable origin, hydrogenated naphthalenes and the like. Aqueous or oily suspensions for injection can be prepared by using an appropriate emulsifier or humidifier and a suspending agent, according to known methods. Agents for injection can be a non-toxic, non-orally administrable diluting agent, such as aqueous solution, a sterile injectable solution or suspension in a solvent. As the usable vehicle or solvent, water, Ringer's solution, isotonic saline, etc. are allowed; as an ordinary solvent or suspending solvent, sterile involatile oil can be used. For these purposes, any kind of involatile oil and fatty acid can be used, including natural or synthetic or semisynthetic fatty oils or fatty acids; natural or synthetic or semi-synthetic mono- or di- or tri-glycerides. Parental administration is known in the art and includes, but is not limited to, conventional means of injections, a gas pressured needleless injection device as described in U.S. Pat. No. 5,851,198, and a laser perforator device as described in U.S. Pat. No. 5,839,446 entirely incorporated herein by reference.

Alternative Delivery

The invention further relates to the administration of at least one protein scaffold by parenteral, subcutaneous, intramuscular, intravenous, intrarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiae, intraperitoneal, intrapleural, intraprostatic, intrapulmonary, intrarectal, intrarenal, intraretinal, intraspinal, intrasynovial, intrathoracic, intrauterine, intravesical, intralesional, bolus, vaginal, rectal, buccal, sublingual, intranasal, or transdermal means. At least one protein scaffold composition can be prepared for use for parenteral (subcutaneous, intramuscular or intravenous) or any other administration particularly in the form of liquid solutions or suspensions; for use in vaginal or rectal administration particularly in semisolid forms, such as, but not limited to, creams and suppositories; for buccal, or sublingual administration, such as, but not limited to, in the form of tablets or capsules; or intranasally, such as, but not limited to, the form of powders, nasal drops or aerosols or certain agents; or transdermally, such as not limited to a gel, ointment, lotion, suspension or patch delivery system with chemical enhancers such as dimethyl sulfoxide to either modify the skin structure or to increase the drug concentration in the transdermal patch (Junginger, et al. In "Drug Permeation Enhancement;" Hsieh, D. S., Eds., pp. 59-90 (Marcel Dekker, Inc. New York 1994, entirely incorporated herein by reference), or with oxidizing agents that enable the application of formulations containing proteins and peptides onto the skin (WO 98/53847), or applications of electric fields to create transient transport pathways, such as electroporation, or to increase the mobility of charged drugs through the skin, such as iontophoresis, or application of ultrasound, such as sonophoresis (U.S. Pat. Nos. 4,309,989 and 4,767,402) (the above publications and patents being entirely incorporated herein by reference).

Infusion of Modified Cells as Adoptive Cell Therapy

The disclosure provides modified cells that express one or more CARs and/or CARTyrins of the disclosure that have been selected and/or expanded for administration to a subject in need thereof. Modified cells of the disclosure may be formulated for storage at any temperature including room temperature and body temperature. Modified cells of the disclosure may be formulated for cryopreservation and subsequent thawing. Modified cells of the disclosure may be formulated in a pharmaceutically acceptable carrier for direct administration to a subject from sterile packaging. Modified cells of the disclosure may be formulated in a pharmaceutically acceptable carrier with an indicator of cell viability and/or CAR/CARTyrin expression level to ensure a minimal level of cell function and CAR/CARTyrin expression. Modified cells of the disclosure may be formulated in a pharmaceutically acceptable carrier at a prescribed density with one or more reagents to inhibit further expansion and/or prevent cell death.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises between $2 \times 10^5$ and $5 \times 10^8$ cells per kg of body weight of the patient per administration, or any range, value or fraction thereof.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises between $0.2 \times 10^6$ to $20 \times 10^6$ cells per kg of body weight of the patient per administration. In certain embodiments, a therapeutically effective dose of a composition of the disclosure or of compositions comprising modified cells of the disclosure comprises $0.2 \times 10^6$ cells per kg of body weight of the patient per administration, $2 \times 10^6$ cells per kg of body weight of the patient per administration. $20 \times 10^6$ cells per kg of body weight of the patient per administration, or any cells per kg of body weight of the patient per administration in between.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises $1 \times 10^6$ cells or about $1 \times 10^6$ cells per kg of body weight of the patient per administration.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises $3 \times 10^6$ cells or about $3 \times 10^6$ cells per kg of body weight of the patient per administration.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises between $0.7 \times 10^6$ to $6.7 \times 10^6$ cells per kg of body weight of the patient per administration. In certain embodiments, a therapeutically effective dose of a composition of the disclosure or of compositions comprising modified cells of the disclosure comprises $0.7 \times 10^6$ cells per kg of body weight of the patient per administration, $6.7 \times 10^6$ cells per kg of body weight of the patient per administration or any cells per kg of body weight of the patient per administration in between.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises between $0.7 \times 10^6$ to $16 \times 10^6$ cells per kg of body weight of the patient per administration. In certain embodiments, a therapeutically effective dose of a composition of the disclosure or of compositions comprising modified cells of the disclosure comprises $0.7 \times 10^6$ cells per kg of body weight of the patient per administration, $2\times10^6$ cells per kg of body weight of the patient per admiration, $6\times10^6$ cells per kg of body weight of the patient per administration, $10.7\times10^6$ cells per kg of body weight of the patient per administration, $16\times10^6$ cells per kg of body weight of the patient per administration or any cells per kg of body weight of the patient per administration in between.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises $1.2\times10^6$ to $7.1\times10^6$ cells per kg of body weight of the patient per administration. In certain embodiments, a therapeutically effective dose of a composition of the disclosure or of compositions comprising modified cells of the disclosure comprises $1.2\times10^6$ cells per kg of body weight of the patient per administration, $7.1\times10^6$ cells per kg of body weight of the patient per administration or any number of cells per kg of body weight of the patient per administration. In certain embodiments, a therapeutically effective dose of a composition of the disclosure or of compositions comprising modified cells of the disclosure comprises between $2\times10^6$ to $3\times10^6$ cells per kg of body weight of the patient per administration.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises $1106\times10^6$ to $2106\times10^6$ cells per kg of body weight of the patient per administration. In certain embodiments, a therapeutically effective dose of a composition of the disclosure or of compositions comprising modified cells of the disclosure comprises $1106\times10^6$ cells per kg of body weight of the patient per administration, $2106\times10^6$ cells per kg of body weight of the patient per administration or any number of cells per kg of body weight of the patient per administration in between. In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises $0.7\times10^6$ to $1.3\times10^6$ cells per kg of body weight of the patient per administration. In certain embodiments, a therapeutically effective dose of a composition of the disclosure or of compositions comprising modified cells of the disclosure comprises $0.7\times10^6$ cells per kg of body weight of the patient per administration, $1.3\times10^6$ cells per kg of body weight of the patient per administration or any number of cells per kg of body weight of the patient per administration in between.

In certain embodiments of the disclosure, modified cells of the disclosure are delivered to a patient via injection or intravenous infusion. In certain embodiments, a therapeutically effective dose of a composition of the disclosure or of compositions comprising modified cells of the disclosure comprises a single or multiple doses. In certain embodiments, a therapeutically effective dose of a composition of the disclosure or of compositions comprising modified cells of the disclosure comprises a split dose. In certain embodiments, a therapeutically effective dose of a composition of the disclosure or of compositions comprising modified cells of the disclosure comprises an initial dose and a maintenance dose.

In certain embodiments of the disclosure, the modified cells are T cells and the T cells may be sorted according to T cell markers prior to either in vitro expansion or formulation with a pharmaceutically acceptable carrier. In some embodiments, modified T cells may be sorted on using CD8+ and/or CD4+ markers.

Inducible Proapoptotic Polypeptides

Inducible proapoptotic polypeptides of the disclosure are superior to existing inducible polypeptides because the inducible proapoptotic polypeptides of the disclosure are far less immunogenic. While inducible proapoptotic polypeptides of the disclosure are recombinant polypeptides, and, therefore, non-naturally occurring, the sequences that are recombined to produce the inducible proapoptotic polypeptides of the disclosure do not comprise non-human sequences that the host human immune system could recognize as "non-self" and, consequently, induce an immune response in the subject receiving an inducible proapoptotic polypeptide of the disclosure, a cell comprising the inducible proapoptotic polypeptide or a composition comprising the inducible proapoptotic polypeptide or the cell comprising the inducible proapoptotic polypeptide.

The disclosure provides inducible proapoptotic polypeptides comprising a ligand binding region, a linker, and a proapoptotic peptide, wherein the inducible proapoptotic polypeptide does not comprise a non-human sequence. In certain embodiments, the non-human sequence comprises a restriction site. In certain embodiments, the proapoptotic peptide is a caspase polypeptide. In certain embodiments, the caspase polypeptide is a caspase 9 polypeptide. In certain embodiments, the caspase 9 polypeptide is a truncated caspase 9 polypeptide. Inducible proapoptotic polypeptides of the disclosure may be non-naturally occurring.

Caspase polypeptides of the disclosure include, but are not limited to, caspase 1, caspase 2, caspase 3, caspase 4, caspase 5, caspase 6, caspase 7, caspase 8, caspase 9, caspase 10, caspase 11, caspase 12, and caspase 14. Caspase polypeptides of the disclosure include, but are not limited to, those caspase polypeptides associated with apoptosis including caspase 2, caspase 3, caspase 6, caspase 7, caspase 8, caspase 9, and caspase 10. Caspase polypeptides of the disclosure include, but are not limited to, those caspase polypeptides that initiate apoptosis, including caspase 2, caspase 8, caspase 9, and caspase 10. Caspase polypeptides of the disclosure include, but are not limited to, those caspase polypeptides that execute apoptosis, including caspase 3, caspase 6, and caspase 7.

Caspase polypeptides of the disclosure may be encoded by an amino acid or a nucleic acid sequence having one or more modifications compared to a wild type amino acid or a nucleic acid sequence. The nucleic acid sequence encoding a caspase polypeptide of the disclosure may be codon optimized. The one or more modifications to an amino acid and/or nucleic acid sequence of a caspase polypeptide of the disclosure may increase an interaction, a cross-linking, a cross-activation, or an activation of the caspase polypeptide of the disclosure compared to a wild type amino acid or a nucleic acid sequence. Alternatively. or in addition, the one or more modifications to an amino acid and/or nucleic acid sequence of a caspase polypeptide of the disclosure may decrease the immunogenicity of the caspase poly peptide of the disclosure compared to a wild type amino acid or a nucleic acid sequence.

Caspase polypeptides of the disclosure may be truncated compared to a wild type caspase polypeptide. For example, a caspase polypeptide may be truncated to eliminate a sequence encoding a Caspase Activation and Recruitment Domain (CARD) to eliminate or minimize the possibility of activating a local inflammatory response in addition to initiating apoptosis in the cell comprising an inducible caspase polypeptide of the disclosure. The nucleic acid sequence encoding a caspase polypeptide of the disclosure may be spliced to form a variant amino acid sequence of the caspase polypeptide of the disclosure compared to a wild type caspase polypeptide. Caspase polypeptides of the disclosure may be encoded by recombinant and/or chimeric sequences. Recombinant and/or chimeric caspase polypeptides of the disclosure may include sequences from one or more different caspase polypeptides. Alternatively, or in addition, recombinant and/or chimeric caspase poly peptides of the disclosure may include sequences from one or more species (e.g. a human sequence and a non-human sequence). Caspase polypeptides of the disclosure may be non-naturally occurring.

The ligand binding region of an inducible proapoptotic polypeptide of the disclosure may include any polypeptide sequence that facilitates or promotes the dimerization of a first inducible proapoptotic polypeptide of the disclosure with a second inducible proapoptotic polypeptide of the disclosure, the dimerization of which activates or induces cross-linking of the proapoptotic polypeptides and initiation of apoptosis in the cell.

The ligand-binding ("dimerization") region may comprise any polypeptide or functional domain thereof that will allow for induction using an endogenous or non-naturally occurring ligand (i.e, and induction agent), for example, a non-naturally occurring synthetic ligand. The ligand-binding region may be internal or external to the cellular membrane, depending upon the nature of the inducible proapoptotic polypeptide and the choice of ligand (i.e. induction agent). A wide variety of ligand-binding polypeptides and functional domains thereof, including receptors, are known. Ligand-binding regions of the disclosure may include one or more sequences from a receptor. Of particular interest are ligand-binding regions for which ligands (for example, small organic ligands) are known or may be readily produced. These ligand-binding regions or receptors may include, but are not limited to, the FKBPs and cyclophilin receptors, the steroid receptors, the tetracycline receptor, and the like, as well as "non-naturally occurring" receptors, which can be obtained from antibodies, particularly the heavy or light chain subunit, mutated sequences thereof, random amino acid sequences obtained by stochastic procedures, combinatorial syntheses, and the like. In certain embodiments, the ligand-binding region is selected from the group consisting of a FKBP ligand-binding region, a cyclophilin receptor ligand-binding region, a steroid receptor ligand-binding region, a cyclophilin receptors ligand-binding region, and a tetracycline receptor ligand-binding region.

The ligand-binding regions comprising one or more receptor domain(s) may be at least about 50 amino acids, and fewer than about 350 amino acids, usually fewer than 200 amino acids, either as the endogenous domain or truncated active portion thereof. The binding region may, for example, be small (<25 kDa, to allow efficient transfection in viral vectors), monomeric, nonimmunogenic, have synthetically accessible, cell permeable, nontoxic ligands that can be configured for dimerization.

The ligand-binding regions comprising one or more receptor domain(s) may be intracellular or extracellular depending upon the design of the inducible proapoptotic polypeptide and the availability of an appropriate ligand (i.e. induction agent). For hydrophobic ligands, the binding region can be on either side of the membrane, but for hydrophilic ligands, particularly protein ligands, the binding region will usually be external to the cell membrane, unless there is a transport system for internalizing the ligand in a form in which it is available for binding. For an intracellular receptor, the inducible proapoptotic polypeptide or a transposon or vector comprising the inducible proapoptotic polypeptide may encode a signal peptide and transmembrane domain 5' or 3' of the receptor domain sequence or may have a lipid attachment signal sequence 5' of the receptor domain sequence. Where the receptor domain is between the signal peptide and the transmembrane domain, the receptor domain will be extracellular.

Antibodies and antibody subunits, e.g., heavy or light chain, particularly fragments, more particularly all or part of the variable region, or fusions of heavy and light chain to create high-affinity binding, can be used as a ligand binding region of the disclosure. Antibodies that are contemplated include ones that are an ectopically expressed human product, such as an extracellular domain that would not trigger an immune response and generally not expressed in the periphery (i.e., outside the CNS/brain area). Such examples, include, but are not limited to low affinity nerve growth factor receptor (LNGFR), and embryonic surface proteins (i.e., carcinoembryonic antigen). Yet further, antibodies can be prepared against haptenic molecules, which are physiologically acceptable, and the individual antibody subunits screened for binding affinity. The cDNA encoding the subunits can be isolated and modified by deletion of the constant region, portions of the variable region, mutagenesis of the variable region, or the like, to obtain a binding protein domain that has the appropriate affinity for the ligand. In this way, almost any physiologically acceptable haptenic compound can be employed as the ligand or to provide an epitope for the ligand. Instead of antibody units, endogenous receptors can be employed, where the binding region or domain is known and there is a useful or known ligand for binding.

For multimerizing the receptor, the ligand for the ligand-binding region/receptor domains of the inducible proapoptotic polypeptides may be multimeric in the sense that the ligand can have at least two binding sites, with each of the binding sites capable of binding to a ligand receptor region (i.e. a ligand having a first binding site capable of binding the ligand-binding region of a first inducible proapoptotic polypeptide and a second binding site capable of binding the ligand-binding region of a second inducible proapoptotic polypeptide, wherein the ligand-binding regions of the first and the second inducible proapoptotic polypeptides are either identical or distinct). Thus, as used herein, the term "multimeric ligand binding region" refers to a ligand-binding region of an inducible proapoptotic polypeptide of the disclosure that binds to a multimeric ligand. Multimeric ligands of the disclosure include dimeric ligands. A dimeric ligand of the disclosure may have two binding sites capable of binding to the ligand receptor domain. In certain embodiments, multimeric ligands of the disclosure are a dimer or higher order oligomer, usually not greater than about tetrameric, of small synthetic organic molecules, the individual molecules typically being at least about 150 Da and less than about 5 kDa, usually less than about 3 kDa. A variety of pairs of synthetic ligands and receptors can be employed. For example, in embodiments involving endogenous receptors, dimeric FK506 can be used with an FKBP12 receptor, dimerized cyclosporin A can be used with the cyclophilin receptor, dimerized estrogen with an estrogen receptor, dimerized glucocorticoids with a glucocorticoid receptor, dimerized tetracycline with the tetracycline receptor, dimerized vitamin D with the vitamin D receptor, and the like. Alternatively higher orders of the ligands, e.g., trimeric can be used. For embodiments involving non-naturally occurring receptors, e.g., antibody subunits, modified antibody subunits, single chain antibodies comprised of heavy and light chain variable regions in tandem, separated by a flexible linker, or modified receptors, and mutated sequences thereof, and the like, any of a large variety of compounds can be used. A significant characteristic of the units comprising a multimeric ligand of the disclosure is that each binding site is able to bind the receptor with high affinity, and preferably, that they are able to be dimerized chemically. Also, methods are available to balance the hydrophobicity/hydrophilicity of the ligands so that they are able to dissolve in serum at functional levels, yet diffuse across plasma membranes for most applications.

Activation of inducible proapoptotic polypeptides of the disclosure may be accomplished through, for example, chemically induced dimerization (CID) mediated by an induction agent to produce a conditionally controlled protein or polypeptide. Proapoptotic polypeptides of the disclosure not only inducible, but the induction of these polypeptides is also reversible, due to the degradation of the labile dimerizing agent or administration of a monomeric competitive inhibitor.

In certain embodiments, the ligand binding region comprises a FK506 binding protein 12 (FKBP12) polypeptide. In certain embodiments, the ligand binding region comprises a FKBP12 poly peptide having a substitution of valine (V) for phenylalanine (F) at position 36 (F36V) In certain embodiments, in which the ligand binding region comprises a FKBP12 polypeptide having a substitution of valine (V) for phenylalanine (F) at position 36 (F36V), the induction agent may comprise AP1903, a synthetic drug (CAS Index Name: 2-Piperidinecarboxylic acid, 1-[(2S)-1-oxo-2-(3,4,5-trimethoxyphenyl)butyl]-, 1,2-ethanediylbis[imino(2-oxo-2,1-ethanediyl)oxy-3,1-phenylene[(1 R)-3-(3,4-dimethoxyphenyl)propylidene]]ester, [2S-[1(R*),2R*[S*[S*[1(R*), 2R*]]]]]-(9Cl) CAS Registry Number 195514-63-7; Molecular Formula: C78H98N4O20; Molecular Weight: 1411.65)). In certain embodiments, in which the ligand binding region comprises a FKBP12 polypeptide having a substitution of valine (V) for phenylalanine (F) at position 36 (F36V), the induction agent may comprise AP20187 (CAS Registry Number: 195514-80-8 and Molecular Formula: C82H107N5O20). In certain embodiments, the induction agent is an AP20187 analog, such as, for example, AP1510. As used herein, the induction agents AP20187, AP1903 and AP1510 may be used interchangeably.

AP1903 API is manufactured by Alphora Research Inc, and AP1903 Drug Product for Injection is made by Formatech Inc. It is formulated as a 5 mg/mL solution of AP1903 in a 25% solution of the non-ionic solubilizer Solutol HS 15 (250 mg/mL, BASF). At room temperature, this formulation is a clear, slightly yellow solution. Upon refrigeration, this formulation undergoes a reversible phase transition, resulting in a milky solution. This phase transition is reversed upon re-warming to room temperature. The fill is 2.33 mL in a 3 mL glass vial (approximately 10 mg AP1903 for Injection total per vial). Upon determining a need to administer AP1903, patients may be, for example, administered a single fixed dose of AP1903 for Injection (0.4 mg/kg) via IV infusion over 2 hours, using a non-DEHP, non-ethylene oxide sterilized infusion set. The dose of AP1903 is calculated individually for all patients, and is not be recalculated unless body weight fluctuates by ≥10%. The calculated dose is diluted in 100 mL in 0.9% normal saline before infusion. In a previous Phase I study of AP1903, 24 healthy volunteers were treated with single doses of AP1903 for Injection at dose levels of 0.01, 0.05, 0.1, 0.5 and 1.0 mg/kg infused IV over 2 hours. AP1903 plasma levels were directly proportional to dose, with mean Cmax values ranging from approximately 10-1275 ng/mL over the 0.01-1.0 mg/kg dose range. Following the initial infusion period, blood concentrations demonstrated a rapid distribution phase, with plasma levels reduced to approximately 18, 7, and 1% of maximal concentration at 0.5, 2 and 10 hours post-dose, respectively. AP1903 for Injection was shown to be safe and well tolerated at all dose levels and demonstrated a favorable pharmacokinetic profile. Iuliucci J D, et al., J Clin Pharmacol. 41: 870-9, 2001.

The fixed dose of AP1903 for injection used, for example, may be 0.4 mg/kg intravenously infused over 2 hours. The amount of AP1903 needed in vitro for effective signaling of cells is 10-100 nM (1600 Da MW). This equates to 16-160 µg/L or ~0.016-1.6 µg/kg (1.6-160 µg/kg). Doses up to 1 mg/kg were well-tolerated in the Phase I study of AP1903 described above. Therefore, 0.4 mg/kg may be a safe and effective dose of AP1903 for this Phase I study in combination with the therapeutic cells.

The amino acid and/or nucleic acid sequence encoding ligand binding of the disclosure may contain sequence one or more modifications compared to a wild type amino acid or nucleic acid sequence. For example, the amino acid and/or nucleic acid sequence encoding ligand binding region of the disclosure may be a codon-optimized sequence. The one or more modifications may increase the binding affinity of a ligand (e.g. an induction agent) for the ligand binding region of the disclosure compared to a wild type polypeptide. Alternatively. or in addition, the one or more modifications may decrease the immunogenicity of the ligand binding region of the disclosure compared to a wild type polypeptide. Ligand binding regions of the disclosure and/or induction agents of the disclosure may be non-naturally occurring.

Inducible proapoptotic polypeptides of the disclosure comprise a ligand binding region, a linker and a proapoptotic peptide, wherein the inducible proapoptotic polypeptide does not comprise a non-human sequence. In certain embodiments, the non-human sequence comprises a restriction site. The linker may comprise any organic or inorganic material that permits, upon dimerization of the ligand binding region, interaction, cross-linking, cross-activation, or activation of the proapoptotic polypeptides such that the interaction or activation of the proapoptotic polypeptides initiates apoptosis in the cell. In certain embodiments, the linker is a polypeptide. In certain embodiments, the linker is a polypeptide comprising a G/S rich amino acid sequence (a "GS" linker). In certain embodiments, the linker is a polypeptide comprising the amino acid sequence GGGGS (SEQ ID NO: 17014). In preferred embodiments, the linker is a polypeptide and the nucleic acid encoding the poly peptide does not contain a restriction site for a restriction endonuclease. Linkers of the disclosure may be non-naturally occurring.

Inducible proapoptotic polypeptides of the disclosure may be expressed in a cell under the transcriptional regulation of any promoter capable of initiating and/or regulating the expression of an inducible proapoptotic polypeptide of the disclosure in that cell. The term "promoter" as used herein refers to a promoter that acts as the initial binding site for RNA polymerase to transcribe a gene. For example, inducible proapoptotic polypeptides of the disclosure may be expressed in a mammalian cell under the transcriptional regulation of any promoter capable of initiating and/or regulating the expression of an inducible proapoptotic polypeptide of the disclosure in a mammalian cell, including, but not limited to native, endogenous, exogenous, and heterologous promoters. Preferred mammalian cells include human cells. Thus, inducible proapoptotic polypeptides of the disclosure may be expressed in a human cell under the transcriptional regulation of any promoter capable of initiating and/or regulating the expression of an inducible proapoptotic polypeptide of the disclosure in a human cell, including, but not limited to, a human promoter or a viral promoter. Exemplary promoters for expression in human cells include, but are not limited to, a human cytomegalovirus (CMV) immediate early gene promoter, a SV40 early promoter, a Rous sarcoma virus long terminal repeat, β-actin promoter, a rat insulin promoter and a glyceraldehyde-3-phosphate dehydrogenase promoter, each of which may be used to obtain high-level expression of an inducible proapoptotic polypeptide of the disclosure. The use of other viral or mammalian cellular or bacterial phage promoters which are well known in the art to achieve expression of an inducible proapoptotic polypeptide of the disclosure is contemplated as well, provided that the levels of expression are sufficient for initiating apoptosis in a cell. By employing a promoter with well-known properties, the level and pattern of expression of the protein of interest following transfection or transformation can be optimized.

Selection of a promoter that is regulated in response to specific physiologic or synthetic signals can permit inducible expression of the inducible proapoptotic polypeptide of the disclosure. The ecdysone system (Invitrogen, Carlsbad, Calif.) is one such system. This system is designed to allow regulated expression of a gene of interest in mammalian cells. It consists of a tightly regulated expression mechanism that allows virtually no basal level expression of a transgene, but over 200-fold inducibility. The system is based on the heterodimeric ecdysone receptor of *Drosophila*, and when ecdysone or an analog such as muristerone A binds to the receptor, the receptor activates a promoter to turn on expression of the downstream transgene high levels of mRNA transcripts are attained. In this system, both monomers of the heterodimeric receptor are constitutively expressed from one vector, whereas the ecdysone-responsive promoter, which drives expression of the gene of interest, is on another plasmid. Engineering of this type of system into a vector of interest may therefore be useful. Another inducible system that may be useful is the Tet-Off™ or Tet-On™ system (Clontech. Palo Alto, Calif.) originally developed by Gossen and Bujard (Gossen and Bujard, Proc. Natl. Acad. Sci. USA, 89:5547-5551, 1992; Gossen et al., Science, 268:1766-1769, 1995). This system also allows high levels of gene expression to be regulated in response to tetracycline or tetracycline derivatives such as doxycycline. In the Tet-On™ system, gene expression is turned on in the presence of doxycycline, whereas in the Tet-Off™ system, gene expression is turned on in the absence of doxycycline. These systems are based on two regulatory elements derived from the tetracycline resistance operon of *E. coli*: the tetracycline operator sequence (to which the tetracycline repressor binds) and the tetracycline repressor protein. The gene of interest is cloned into a plasmid behind a promoter that has tetracycline-responsive elements present in it. A second plasmid contains a regulatory element called the tetracycline-controlled transactivator, which is composed, in the Tet-Off™ system, of the VP16 domain from the herpes simplex virus and the wild-type tetracycline repressor. Thus in the absence of doxycycline, transcription is constitutively on. In the Tet-On™ system, the tetracycline repressor is not wild type and in the presence of doxycycline activates transcription. For gene therapy vector production, the Tet-Off™ system may be used so that the producer cells could be grown in the presence of tetracycline or doxycycline and prevent expression of a potentially toxic transgene, but when the vector is introduced to the patient, the gene expression would be constitutively on.

In some circumstances, it is desirable to regulate expression of a transgene in a gene therapy vector. For example, different viral promoters with varying strengths of activity are utilized depending on the level of expression desired. In mammalian cells, the CMV immediate early promoter is often used to provide strong transcriptional activation. The CMV promoter is reviewed in Donnelly, J. J., et al., 1997. Annu. Rev. Immunol. 15:617-48. Modified versions of the CMV promoter that are less potent have also been used when reduced levels of expression of the transgene are desired. When expression of a transgene in hematopoietic cells is desired, retroviral promoters such as the LTRs from MLV or MMTV are often used. Other viral promoters that are used depending on the desired effect include SV40, RSV LTR, HIV-1 and HIV-2 LTR, adenovirus promoters such as from the E1A, E2A, or MLP region, AAV LTR, HSV-TK, and avian sarcoma virus.

In other examples, promoters may be selected that are developmentally regulated and are active in particular differentiated cells. Thus, for example, a promoter may not be active in a pluripotent stem cell, but, for example, where the pluripotent stem cell differentiates into a more mature cell, the promoter may then be activated.

Similarly tissue specific promoters are used to effect transcription in specific tissues or cells so as to reduce potential toxicity or undesirable effects to non-targeted tissues. These promoters may result in reduced expression compared to a stronger promoter such as the CMV promoter, but may also result in more limited expression, and immunogenicity (Bojak, A., et al., 2002. Vaccine. 20:1975-79; Cazeaux, N., et al., 2002. Vaccine 20:3322-31). For example, tissue specific promoters such as the PSA associated promoter or prostate-specific glandular kallikrein, or the muscle creatine kinase gene may be used where appropriate.

Examples of tissue specific or differentiation specific promoters include, but are not limited to, the following: B29 (B cells); CD14 (monocytic cells); CD43 (leukocytes and platelets); CD45 (hematopoietic cells); CD68 (macrophages); desmin (muscle); elastase-1 (pancreatic acinar cells); endoglin (endothelial cells); fibronectin (differentiating cells, healing tissues); and Flt-1 (endothelial cells); GFAP (astrocytes).

In certain indications, it is desirable to activate transcription at specific times after administration of the gene therapy vector. This is done with such promoters as those that are hormone or cytokine regulatable Cytokine and inflammatory protein responsive promoters that can be used include K and T kininogen (Kageyama et al., (1987) J. Biol. Chem., 262, 2345-2351), c-fos, TNF-alpha, C-reactive protein (Arcone, et al., (1988) Nucl. Acids Res., 16(8), 3195-3207), haptoglobin (Oliviero et al., (1987) EMBO J., 6, 1905-1912), serum amyloid A2, C/EBP alpha, IL-1, IL-6 (Poli and Cortese. (1989) Proc. Nat'l Acad. Sci. USA, 86, 8202-8206), Complement C3 (Wilson et al., (1990) Mol. Cell. Biol., 6181-6191), IL-8, alpha-1 acid glycoprotein (Prowse and Baumann. (1988) Mol Cell Biol, 8, 42-51), alpha-1 antitrypsin, lipoprotein lipase (Zechner et al., Mol. Cell. Biol., 2394-2401, 1988), angiotensinogen (Ron, et al., (1991) Mol. Cell. Biol., 2887-2895), fibrinogen, c-jun (inducible by phorbol esters, TNF-alpha, UV radiation, retinoic acid, and hydrogen peroxide), collagenase (induced by phorbol esters and retinoic acid), metallothionein (heavy metal and glucocorticoid inducible), Stromelysin (inducible by phorbol ester, interleukin-1 and EGF), alpha-2 macroglobulin and alpha-1 anti-chymotrypsin. Other promoters include, for example, SV40, MMTV, Human Immunodeficiency Virus (MV), Moloney virus, ALV, Epstein Barr virus, Rous Sarcoma virus, human actin, myosin, hemoglobin, and creatine.

It is envisioned that any of the above promoters alone or in combination with another can be useful depending on the action desired. Promoters, and other regulatory elements, are selected such that they are functional in the desired cells or tissue. In addition, this list of promoters should not be construed to be exhaustive or limiting; other promoters that are used in conjunction with the promoters and methods disclosed herein.

Armored T-Cells "Knock Down" Strategy

T-cells of the disclosure may be genetically modified to enhance their therapeutic potential. Alternatively, or in addition, T-cells of the disclosure may be modified to render them less sensitive to immunologic and/or metabolic checkpoints. Modifications of this type "armor" the T cells of the disclosure, which, following the modification, may be referred to here as "armored" T cells. Armored T cells of the disclosure may be produced by, for example, blocking and/or diluting specific endogenous checkpoint signals delivered to the T-cells (i.e. checkpoint inhibition) within the tumor immunosuppressive microenvironment, for example.

In some embodiments, an armored T-cell of the disclosure is derived from a T cell, a NK cell, a hematopoietic progenitor cell, a peripheral blood (PB) derived T cell (including a T cell isolated or derived from G-CSF-mobilized peripheral blood), or an umbilical cord blood (UCB) derived T cell. In some embodiments, an armored T-cell of the disclosure comprises one or more of a chimeric ligand receptor (CLR comprising a protein scaffold, an antibody, an ScFv, or an antibody mimetic)/chimeric antigen receptor (CAR comprising a protein scaffold, an antibody, an ScFv. or an antibody mimetic), a CARTyrin (a CAR comprising a Centyrin), and/or a VCAR (a CAR comprising a camelid VHH or a single domain VH) of the disclosure. In some embodiments, an armored T-cell of the disclosure comprises an inducible proapoptotic polypeptide comprising (a) a ligand binding region, (b) a linker, and (c) a truncated caspase 9 poly peptide, wherein the inducible proapoptotic polypeptide does not comprise a non-human sequence. In some embodiments, the non-human sequence is a restriction site. In some embodiments, the ligand binding region inducible caspase polypeptide comprises a FK506 binding protein 12 (FKBP12) polypeptide. In some embodiments, the amino acid sequence of the FK506 binding protein 12 (FKBP12) polypeptide comprises a modification at position 36 of the sequence. In some embodiments, the modification is a substitution of valine (V) for phenylalanine (F) at position 36 (F36V). In some embodiments, an armored T-cell of the disclosure comprises an exogenous sequence. In some embodiments, the exogenous sequence comprises a sequence encoding a therapeutic protein. Exemplary therapeutic proteins may be nuclear, cytoplasmic, intracellular, transmembrane, cell-surface bound, or secreted proteins. Exemplary therapeutic proteins expressed by the armored T cell may modify an activity of the armored T cell or may modify an activity of a second cell. In some embodiments, an armored T-cell of the disclosure comprises a selection gene or a selection marker. In some embodiments, an armored T-cell of the disclosure comprises a synthetic gene expression cassette (also referred to herein as an inducible transgene construct).

In some embodiments, a T-cell of the disclosure is modified to silence or reduce expression one or more gene(s) encoding receptor(s) of inhibitory checkpoint signals to produce an armored T-cell of the disclosure. Examples of inhibitory checkpoint signals include, but are not limited to, a PD-L1 ligand binding to a PD-1 receptor on a CAR-T cell of the disclosure or a TGFβ cytokine binding to a TGFβRII receptor on a CAR-T cell. Receptors of inhibitory checkpoint signals are expressed on the cell surface or within the cytoplasm of a T-cell. Silencing or reducing expressing of the gene encoding the receptor of the inhibitory checkpoint signal results a loss of protein expression of the inhibitory checkpoint receptors on the surface or within the cytoplasm of an armored T-cell of the disclosure. Thus, armored T cells of the disclosure having silenced or reduced expression of one or more genes encoding an inhibitory checkpoint receptor is resistant, non-receptive or insensitive to checkpoint signals. The armored T cell's resistance or decreased sensitivity to inhibitory checkpoint signals enhances the armored T cell's therapeutic potential in the presence of these inhibitory checkpoint signals. Inhibitory checkpoint signals include but are not limited to the examples listed in Table 2. Exemplary inhibitory checkpoint signals that may be silenced in an armored T cell of the disclosure include, but are not limited to, PD-1 and TGFβRII.

TABLE 2

Exemplary Inhibitory Checkpoint Signals (and proteins that induce immunosuppression).

| Full Name | Abbreviation | SEQ ID NO: |
| --- | --- | --- |
| Programmed cell death protein 1 | PD1 | 14643-14644 |
| transforming growth factor β Receptor 1 | TGFβR1 | 14645 |
| transforming growth factor β Receptor 2 | TGFβR2 | 14646 |
| T-cell immunoglobulin and mucin-domain containing-3 | TIM3 | 14647 |
| Lymphocyte-activation gene 3 | LAG3 | 14648 |
| Cytotoxic T-lymphocyte protein 4 | CTLA4 | 14649 |
| B- and T-lymphocyte attenuator | BTLA | 14650 |
| Killer cell immunoglobulin-like receptor | KIR | 14651 |
| Alpha-2A adrenergic receptor | A2aR | 14652 |
| V-type immunoglobulin domain-containing suppressor of T-cell activation | VISTA | 14653 |
| T-cell immunoreceptor with Ig and ITIM domains | TIGIT | 14654 |
| Programmed cell death 1 ligand 1 | B7H1 or PD-L1 | 14655 |
| Programmed cell death 1 ligand 2 | B7DC or PD-L2 | 14656 |

TABLE 2-continued

Exemplary Inhibitory Checkpoint Signals (and proteins that induce immunosuppression).

| Full Name | Abbreviation | SEQ ID NO: |
|---|---|---|
| T-lymphocyte activation antigen CD80 | B7-1 or CD80 | 14657 |
| T-lymphocyte activation antigen CD86 | B7-2 or CD86 | 14658 |
| CD160 antigen | CD160 | 14659 |
| Leukocyte-associated immunoglobulin-like receptor 1 | LAIR1 | 14660 |
| T-cell immunoglobulin and mucin domain-containing protein 4 | TIM4 or TIMD4 | 14661 |
| Natural killer cell receptor 2B4 | 2B4 or CD244 | 14662 |
| Major Histocompatibility Complex type I | MHC I | 14663 |
| Major Histocompatibility Complex type II | MHC II | |
| Putative 2-methylcitrate dehydratase receptor | PDH1R | |
| T-cell immunoglobulin and mucin domain 1 receptor | TIM1R | |
| T-cell immunoglobulin and mucin domain 4 receptor | TIM4R | |
| B7-H3 receptor | B7H3R or CD176 Receptor | |
| B7-H4 receptor | B7H4R | |
| Immunoglobulin-like transcript (ILT) 3 receptor | ILT3R | |
| phosphoinositide 3-kinase, subunit alpha | PI3K alpha | 14664 |
| phosphoinositide 3-kinase, subunit gamma | PI3K gamma | 14665 |
| Tyrosine-protein phosphatase non-receptor type 11 | SHP2 or PTPN11 | 14666 |
| Protein phosphatase 2, subunit gamma | PP2A gamma | 14667 |
| Protein phosphatase 2, subunit beta | PP2A beta | 14668 |
| Protein phosphatase 2, subunit delta | PP2A delta | 14669 |
| Protein phosphatase 2, subunit epsilon | PP2A epsilon | 14670 |
| Protein phosphatase 2, subunit alpha | PP2A alpha | 14671 |
| T-cell Receptor, subunit alpha | TCR alpha | 14672 |
| T-cell Receptor, subunit beta | TCR beta | 14673 |
| T-cell Receptor, subunit zeta | TCR zeta | 14674 |
| T-cell Receptor, subunit CD3 epsilon | TCR CD3 epsilon | 14675 |
| T-cell Receptor, subunit CD3 gamma | TCR CD3 gamma | 14676 |
| T-cell Receptor, subunit CD3 delta | TCR CD3 delta | 14677 |
| Cluster of Differentiation 28 | CD28 | 14678 |
| Galectins | Galectins | |
| Galectin 9 | Galectin 9 | 14679 |
| High Mobility Group Box 1 | HMGB1 | 14680 |
| Arginase 1 | ARG1 | 14681 |
| Prostaglandin-Endoperoxide Synthase 1 | PTGS1 | 14682 |
| Prostaglandin-Endoperoxide Synthase 2 | PTGS2 | 14683 |
| Mucin 1, Cell Surface Associated | MUC1 | 14684 |
| Mucin 2, Oligomeric Mucus/Gel-Forming | MUC2 | 14685 |
| Mucin 3A, Cell Surface Associated | MUC3A | 14686 |
| Mucin 3B, Cell Surface Associated | MUC3B | 14687 |
| Mucin 4, Cell Surface Associated | MUC4 | 14688 |
| Mucin 5AC, Oligomeric Mucus/Gel-Forming | MUC5AC | 14689 |
| Mucin 5B, Oligomeric Mucus/Gel-Forming | MUC5B | 14690 |
| Mucin 6, Oligomeric Mucus/Gel-Forming | MUC6 | 14691 |
| Mucin 7, Secreted | MUC7 | 14692 |
| Mucin 8 | MUC8 | |
| Mucin 12, Cell Surface Associated | MUC12 | 14693 |
| Mucin 13, Cell Surface Associated | MUC13 | 14694 |
| Mucin 15, Cell Surface Associated | MUC15 | 14695 |
| Mucin 16, Cell Surface Associated | MUC16 | 14696 |
| Mucin 17, Cell Surface Associated | MUC17 | 14697 |
| Mucin 19, Oligomeric | MUC19 | 14698 |
| Mucin 20, Cell Surface Associated | MUC20 | 14699 |
| Mucin 21, Cell Surface Associated | MUC21 | 14700 |
| Mucin 22 | MUC22 | 14701 |
| Indoleamine 2,3-Dioxygenase 1 | IDO1 | 14702 |
| Indoleamine 2,3-Dioxygenase 2 | IDO2 | 14703 |
| Inducible T Cell Costimulator Ligand | ICOSLG | 14704 |
| ROS Proto-Oncogene 1, Receptor Tyrosine Kinase | ROS1 | 14705 |
| Tumor Necrosis Factor Receptor Superfamily Member 9 | 4-1BB, CD137, ILA or TNFRSF9 | 14706 |
| 4-1BB Ligand | 4-1BB-L | 14707 |
| Glucocorticoid-induced TNFR family related gene | GITR | 14708 |
| Glucocorticoid-induced TNFR family related gene ligand | GITRL | 14709 |

In some embodiments, a T-cell of the disclosure is modified to silence or reduce expression of one or more gene(s) encoding intracellular proteins involved in checkpoint signaling to produce an armored T-cell of the disclosure. The activity of a T-cell of the disclosure may be enhanced by targeting any intracellular signaling protein involved in a checkpoint signaling pathway thereby achieving checkpoint inhibition or interference to one or more checkpoint pathways. Intracellular signaling proteins involved in checkpoint signaling include, but are not limited to, exemplary intracellular signaling proteins listed in Table 3.

TABLE 3

Exemplary Intracellular Signaling Proteins.

| Full Name | Abbreviation | SEQ ID NO: |
|---|---|---|
| phosphoinositide 3-kinase, subunit alpha | PI3K alpha | 14710 |
| phosphoinositide 3-kinase, subunit gamma | PI3K gamma | 14711 |
| Tyrosine-protein phosphatase non-receptor type 11 | SHP2 or PTPN11 | 14712 |
| Protein phosphatase 2, subunit gamma | PP2A gamma | 14713 |
| Protein phosphatase 2, subunit beta | PP2A beta | 14714 |
| Protein phosphatase 2, subunit delta | PP2A delta | 14715 |
| Protein phosphatase 2, subunit epsilon | PP2A epsilon | 14716 |
| Protein phosphatase 2, subunit alpha | PP2A alpha | 14717 |
| RAC-alpha serine/threonine-protein kinase | AKT or PKB | 14718 |
| Tyrosine-protein kinase ZAP-70 | ZAP70 | 14719 |
| Amino acid sequence (KIEELE)-containing domain protein | KIEELE-domain containing proteins | |
| BCL2 associated athanogene 6 | Bat3, Bag6 or Scythe | 14720 |
| B-cell lymphoma-extra large | Bcl-xL | 14721 |
| Bcl-2-related protein A1 | Bfl-1 or BCL2A1 | 14722 |

In some embodiments, a T-cell of the disclosure is modified to silence or reduce expression of one or more gene(s) encoding a transcription factor that hinders the efficacy of a therapy to produce an armored T-cell of the disclosure. The activity of armored T-cells may be enhanced or modulated by silencing or reducing expression (or repressing a function) of a transcription factor that hinders the efficacy of therapy. Exemplary transcription factors that may be modified to silence or reduce expression or to repress a function thereof include, but are not limited to the exemplary transcription factors listed in Table 4. For example expression of a FOXP3 gene may be silenced or reduced in an armored T cell of the disclosure to prevent or reduce the formation of T regulatory CAR-T-cells (CAR-Treg cells), the expression or activity of which may reduce efficacy of a therapy.

TABLE 4

Exemplary Transcription Factors.

| Full Name | Abbreviation | SEQ ID NO: |
|---|---|---|
| activity-dependent neuroprotector homeobox | ADNP | 14723 |
| ADNP homeobox 2 | ADNP2 | 14724 |
| AE binding protein 1 | AEBP1 | 14725 |
| AE binding protein 2 | AEBP2 | 14726 |
| AF4/FMR2 family member 1 | AFF1 | 14727 |
| AF4/FMR2 family member 2 | AFF2 | 14728 |
| AF4/FMR2 family member 3 | AFF3 | 14729 |
| AF4/FMR2 family member 4 | AFF4 | 14730 |
| AT-hook containing transcription factor 1 | AHCTF1 | 14731 |
| aryl hydrocarbon receptor | AHR | 14732 |
| aryl-hydrocarbon receptor repressor | AHRR | 14733 |
| autoimmune regulator | AIRE | 14734 |
| AT-hook transcription factor | AKNA | 14735 |
| ALX homeobox 1 | ALX1 | 14736 |
| ALX homeobox 3 | ALX3 | 14737 |
| ALX homeobox 4 | ALX4 | 14738 |
| ankyrin repeat and zinc finger domain containing 1 | ANKZF1 | 14739 |
| adaptor related protein complex 5 zeta 1 subunit | AP5Z1 | 14740 |
| androgen receptor | AR | 14741 |
| arginine-fifty homeobox | ARGFX | 14742 |
| Rho GTPase activating protein 35 | ARHGAP35 | 14743 |
| AT-rich interaction domain 1A | ARID1A | 14744 |
| AT-rich interaction domain 1B | ARID1B | 14745 |
| AT-rich interaction domain 2 | ARID2 | 14746 |

TABLE 4-continued

Exemplary Transcription Factors.

| Full Name | Abbreviation | SEQ ID NO: |
|---|---|---|
| AT-rich interaction domain 3A | ARID3A | 14747 |
| AT-rich interaction domain 3B | ARID3B | 14748 |
| AT-rich interaction domain 3C | ARID3C | 14749 |
| AT-rich interaction domain 4A | ARID4A | 14750 |
| AT-rich interaction domain 4B | ARID4B | 14751 |
| AT-rich interaction domain 5A | ARID5A | 14752 |
| AT-rich interaction domain 5B | ARID5B | 14753 |
| aryl hydrocarbon receptor nuclear translocator | ARNT | 14754 |
| aryl hydrocarbon receptor nuclear translocator 2 | ARNT2 | 14755 |
| aryl hydrocarbon receptor nuclear translocator like | ARNTL | 14756 |
| aryl hydrocarbon receptor nuclear translocator like 2 | ARNTL2 | 14757 |
| aristaless related homeobox | ARX | 14758 |
| achaete-scute family bHLH transcription factor 1 | ASCL1 | 14759 |
| achaete-scute family bHLH transcription factor 2 | ASCL2 | 14760 |
| achaete-scute family bHLH transcription factor 3 | ASCL3 | 14761 |
| achaete-scute family bHLH transcription factor 4 | ASCL4 | 14762 |
| achaete-scute family bHLH transcription factor 5 | ASCL5 | 14763 |
| ash1 (absent, small, or homeotic)-like (*Drosophila*) | ASH1L | 14764 |
| ash2 (absent, small, or homeotic)-like (*Drosophila*) | ASH2L | 14765 |
| activating transcription factor 1 | ATF1 | 14766 |
| activating transcription factor 2 | ATF2 | 14767 |
| activating transcription factor 3 | ATF3 | 14768 |
| activating transcription factor 4 | ATF4 | 14769 |
| activating transcription factor 5 | ATF5 | 14770 |
| activating transcription factor 6 | ATF6 | 14771 |
| activating transcription factor 6 beta | ATF6B | 14772 |
| activating transcription factor 7 | ATF7 | 14773 |
| atonal bHLH transcription factor 1 | ATOH1 | 14774 |
| atonal bHLH transcription factor 7 | ATOH7 | 14775 |
| atonal bHLH transcription factor 8 | ATOH8 | 14776 |
| alpha thalassemia/mental retardation syndrome X-linked | ATRX | 14777 |
| ataxin 7 | ATXN7 | 14778 |
| BTB and CNC homology 1, basic leucine zipper transcription factor1 | BACH1 | 14779-14780 |
| BTB domain and CNC homolog 2 | BACH2 | 14781 |
| BarH like homeobox 1 | BARHL1 | 14782 |
| BarH like homeobox 2 | BARHL2 | 14783 |
| BARX homeobox 1 | BARX1 | 14784 |
| BARX homeobox 2 | BARX2 | 14785 |
| Basic Leucine Zipper ATF-Like Transcription Factor, | Batf | 14786 |
| basic leucine zipper transcription factor, ATF-like | BATF | 14786 |
| basic leucine zipper transcription factor, ATF-like 2 | BATF2 | 14787 |
| basic leucine zipper transcription factor, ATF-like 3 | BATF3 | 14788 |
| bobby sox homolog (*Drosophila*) | BBX | 14789 |
| B-cell CLL/lymphoma 11A | BCL11A | 14790 |
| B-cell CLL/lymphoma 11B | BCL11B | 14791 |
| B-cell CLL/lymphoma 3 | BCL3 | 14792 |
| B-cell CLL/lymphoma 6 | BCL6 | 14793 |
| B-cell CLL/lymphoma 6, member B | BCL6B | 14794 |
| BCL2 associated transcription factor 1 | BCLAF1 | 14795 |
| basic helix-loop-helix family member a15 | BHLHA15 | 14796 |
| basic helix-loop-helix family member a9 | BHLHA9 | 14797 |
| basic helix-loop-helix domain containing, class B, 9 | BHLHB9 | 14798 |
| basic helix-loop-helix family member e22 | BHLHE22 | 14799 |
| basic helix-loop-helix family member e23 | BHLHE23 | 14800 |
| basic helix-loop-helix family member e40 | BHLHE40 | 14801 |
| basic helix-loop-helix family member e41 | BHLHE41 | 14802 |
| Beta-Interferon Gene Positive-Regulatory Domain I Binding Factor | Blimp-1 | 14803 |
| bone morphogenetic protein 2 | BMP2 | 14804 |
| basonuclin 1 | BNC1 | 14805 |
| basonuclin 2 | BNC2 | 14806 |
| bolA family member 1 | BOLA1 | 14807 |
| bolA family member 2 | BOLA2 | 14808 |
| bolA family member 3 | BOLA3 | 14809 |
| bromodomain PHD finger transcription factor | BPTF | 14810 |
| breast cancer 1 | BRCA1 | 14811 |
| brain specific homeobox | BSX | 14812 |
| chromosome 20 open reading frame 194 | C20orf194 | 14813 |
| calmodulin binding transcription activator 1 | CAMTA1 | 14814 |
| calmodulin binding transcription activator 2 | CAMTA2 | 14815 |
| calcium regulated heat stable protein 1 | CARHSP1 | 14816 |
| castor zinc finger 1 | CASZ1 | 14817 |
| core-binding factor, beta subunit | CBFB | 14818 |
| coiled-coil domain containing 79 | CCDC79 | 14819 |

TABLE 4-continued

Exemplary Transcription Factors.

| Full Name | Abbreviation | SEQ ID NO: |
|---|---|---|
| cell division cycle 5 like | CDC5L | 14820 |
| caudal type homeobox 1 | CDX1 | 14821 |
| caudal type homeobox 2 | CDX2 | 14822 |
| caudal type homeobox 4 | CDX4 | 14823 |
| CCAAT/enhancer binding protein alpha | CEBPA | 14824 |
| CCAAT/enhancer binding protein beta | CEBPB | 14825 |
| CCAAT/enhancer binding protein delta | CEBPD | 14826 |
| CCAAT/enhancer binding protein epsilon | CEBPE | 14827 |
| CCAAT/enhancer binding protein gamma | CEBPG | 14828 |
| CCAAT/enhancer binding protein zeta | CEBPZ | 14829 |
| centromere protein T | CENPT | 14830 |
| ceramide synthase 3 | CERS3 | 14831 |
| ceramide synthase 6 | CERS6 | 14832 |
| chromosome alignment maintaining phosphoprotein 1 | CHAMP1 | 14833 |
| capicua transcriptional repressor | CIC | 14834 |
| CDKN1A interacting zinc finger protein 1 | CIZ1 | 14835 |
| clock circadian regulator | CLOCK | 14836 |
| CCR4-NOT transcription complex subunit 4 | CNOT4 | 14837 |
| CPX chromosome region, candidate 1 | CPXCR1 | 14838 |
| cramped chromatin regulator homolog 1 | CRAMP1 | 14839 |
| cAMP responsive element binding protein 1 | CREB1 | 14840 |
| cAMP responsive element binding protein 3 | CREB3 | 14841 |
| cAMP responsive element binding protein 3-like 1 | CREB3L1 | 14842 |
| cAMP responsive element binding protein 3-like 2 | CREB3L2 | 14843 |
| cAMP responsive element binding protein 3-like 3 | CREB3L3 | 14844 |
| cAMP responsive element binding protein 3-like 4 | CREB3L4 | 14845 |
| cAMP responsive element binding protein 5 | CREB5 | 14846 |
| CREB binding protein | CREBBP | 14847 |
| cAMP responsive element binding protein-like 2 | CREBL2 | 14848 |
| CREB3 regulatory factor | CREBRF | 14849 |
| CREB/ATF bZIP transcription factor | CREBZF | 14850 |
| cAMP responsive element modulator | CREM | 14851 |
| cone-rod homeobox | CRX | 14852 |
| cysteine-serine-rich nuclear protein 1 | CSRNP1 | 14853 |
| cysteine-serine-rich nuclear protein 2 | CSRNP2 | 14854 |
| cysteine-serine-rich nuclear protein 3 | CSRNP3 | 14855 |
| CCCTC-binding factor (zinc finger protein) | CTCF | 14856 |
| CCCTC-binding factor like | CTCFL | 14857 |
| cut-like homeobox 1 | CUX1 | 14858-14859 |
| cut-like homeobox 2 | CUX2 | 14860 |
| CXXC finger protein 1 | CXXC1 | 14861 |
| dachshund family transcription factor 1 | DACH1 | 14862 |
| dachshund family transcription factor 2 | DACH2 | 14863 |
| D site of albumin promoter (albumin D-box) binding protein | DBP | 14864 |
| developing brain homeobox 1 | DBX1 | 14865 |
| developing brain homeobox 2 | DBX2 | 14866 |
| damage specific DNA binding protein 2 | DDB2 | 14867 |
| DNA damage inducible transcript 3 | DDIT3 | 14868 |
| DEAF1, transcription factor | DEAF1 | 14869 |
| distal-less homeobox 1 | DLX1 | 14870 |
| distal-less homeobox 2 | DLX2 | 14871 |
| distal-less homeobox 3 | DLX3 | 14872 |
| distal-less homeobox 4 | DLX4 | 14873 |
| distal-less homeobox 5 | DLX5 | 14874 |
| distal-less homeobox 6 | DLX6 | 14875 |
| DNA methyltransferase 1 associated protein 1 | DMAP1 | 14876 |
| diencephalon/mesencephalon homeobox 1 | DMBX1 | 14877 |
| doublesex and mab-3 related transcription factor 1 | DMRT1 | 14878 |
| doublesex and mab-3 related transcription factor 2 | DMRT2 | 14879 |
| doublesex and mab-3 related transcription factor 3 | DMRT3 | 14880 |
| DMRT like family A1 | DMRTA1 | 14881 |
| DMRT like family A2 | DMRTA2 | 14882 |
| DMRT like family B with proline rich C-terminal 1 | DMRTB1 | 14883 |
| DMRT like family C1 | DMRTC1 | 14884 |
| DMRT like family C1B | DMRTC1B | 14884 |
| DMRT like family C2 | DMRTC2 | 14885 |
| cyclin D binding myb like transcription factor 1 | DMTF1 | 14886 |
| DnaJ heat shock protein family (Hsp40) member C1 | DNAJC1 | 14887 |
| DnaJ heat shock protein family (Hsp40) member C2 | DNAJC2 | 14888 |
| DnaJ heat shock protein family (Hsp40) member C21 | DNAJC21 | 14889 |
| DNA (cytosine-5-)-methyltransferase 1 | DNMT1 | 14890 |
| DNA (cytosine-5-)-methyltransferase 3 alpha | DNMT3A | 14891 |
| DNA (cytosine-5-)-methyltransferase 3 beta | DNMT3B | 14892 |
| DNA (cytosine-5-)-methyltransferase 3-like | DNMT3L | 14893 |
| double PHD fingers 1 | DPF1 | 14894 |

TABLE 4-continued

Exemplary Transcription Factors.

| Full Name | Abbreviation | SEQ ID NO: |
|---|---|---|
| double PHD fingers 2 | DPF2 | 14895 |
| double PHD fingers 3 | DPF3 | 14896 |
| divergent-paired related homeobox | DPRX | 14897 |
| down-regulator of transcription 1 | DR1 | 14898 |
| DR1 associated protein 1 | DRAP1 | 14899 |
| dorsal root ganglia homeobox | DRGX | 14900 |
| double homeobox 4 | DUX4 | 14901 |
| double homeobox 4 like 9 | DUX4L9 | 14902 |
| double homeobox A | DUXA | 14903 |
| E2F transcription factor 1 | E2F1 | 14904 |
| E2F transcription factor 2 | E2F2 | 14905 |
| E2F transcription factor 3 | E2F3 | 14906 |
| E2F transcription factor 4 | E2F4 | 14907 |
| E2F transcription factor 5 | E2F5 | 14908 |
| E2F transcription factor 6 | E2F6 | 14909 |
| E2F transcription factor 7 | E2F7 | 14910 |
| E2F transcription factor 8 | E2F8 | 14911 |
| E4F transcription factor 1 | E4F1 | 14912 |
| early B-cell factor 1 | EBF1 | 14913 |
| early B-cell factor 2 | EBF2 | 14914 |
| early B-cell factor 3 | EBF3 | 14915 |
| early B-cell factor 4 | EBF4 | 14916 |
| early growth response 1 | EGR1 | 14917 |
| early growth response 2 | EGR2 | 14918 |
| early growth response 3 | EGR3 | 14919 |
| early growth response 4 | EGR4 | 14920 |
| ets homologous factor | EHF | 14921 |
| E74-like factor 1 (ets domain transcription factor) | ELF1 | 14922 |
| E74-like factor 2 (ets domain transcription factor) | ELF2 | 14923 |
| E74-like factor 3 (ets domain transcription factor, epithelial-specific) | ELF3 | 14924 |
| E74-like factor 4 (ets domain transcription factor) | ELF4 | 14925 |
| E74-like factor 5 (ets domain transcription factor) | ELF5 | 14926 |
| ELK1, member of ETS oncogene family | ELK1 | 14927 |
| ELK3, ETS-domain protein (SRF accessory protein 2) | ELK3 | 14928 |
| ELK4, ETS-domain protein (SRF accessory protein 1) | ELKA | 14929 |
| ELM2 and Myb/SANT-like domain containing 1 | ELMSAN1 | 14930 |
| empty spiracles homeobox 1 | EMX1 | 14931 |
| empty spiracles homeobox 2 | EMX2 | 14932 |
| engrailed homeobox 1 | EN1 | 14933 |
| engrailed homeobox 2 | EN2 | 14934 |
| enolase 1, (alpha) | ENO1 | 14935 |
| eomesodermin | EOMES | 14936 |
| endothelial PAS domain protein 1 | EPAS1 | 14937 |
| Ets2 repressor factor | ERF | 14938 |
| v-ets avian erythroblastosis virus E26 oncogene homolog | ERG | 14939-14940 |
| estrogen receptor 1 | ESR1 | 14941 |
| estrogen receptor 2 (ER beta) | ESR2 | 14942 |
| estrogen related receptor alpha | ESRRA | 14943 |
| estrogen related receptor beta | ESRRB | 14944 |
| estrogen related receptor gamma | ESRRG | 14945 |
| ESX homeobox 1 | ESX1 | 14946 |
| v-ets avian erythroblastosis virus E26 oncogene homolog 1 | ETS1 | 14947 |
| v-ets avian erythroblastosis virus E26 oncogene homolog 2 | ETS2 | 14948 |
| ets variant 1 | ETV1 | 14949 |
| ets variant 2 | ETV2 | 14950 |
| ets variant 3 | ETV3 | 14951 |
| ets variant 3-like | ETV3L | 14952 |
| ets variant 4 | ETV4 | 14953 |
| ets variant 5 | ETV5 | 14954 |
| ets variant 6 | ETV6 | 14955 |
| ets variant 7 | ETV7 | 14956 |
| even-skipped homeobox 1 | EVX1 | 14957 |
| even-skipped homeobox 2 | EVX2 | 14958 |
| enhancer of zeste 1 polycomb repressive complex 2 subunit | EZH1 | 14959 |
| enhancer of zeste 2 polycomb repressive complex 2 subunit | EZH2 | 14960 |
| family with sequence similarity 170 member A | FAM170A | 14961 |
| Fer3-like bHLH transcription factor | FERD3L | 14962 |
| FEV (ETS oncogene family) | FEV | 14963 |
| FEZ family zinc finger 1 | FEZF1 | 14964 |
| FEZ family zinc finger 2 | FEZF2 | 14965 |

TABLE 4-continued

Exemplary Transcription Factors.

| Full Name | Abbreviation | SEQ ID NO: |
|---|---|---|
| folliculogenesis specific bHLH transcription factor | FIGLA | 14966 |
| FLT3-interacting zinc finger 1 | FIZ1 | 14967 |
| Fli-1 proto-oncogene, ETS transcription factor | FLI1 | 14968 |
| FBJ murine osteosarcoma viral oncogene homolog | FOS | 14969 |
| FBJ murine osteosarcoma viral oncogene homolog B | FOSB | 14970 |
| FOS like antigen 1 | FOSL1 | 14971 |
| FOS like antigen 2 | FOSL2 | 14972 |
| forkhead box A1 | FOXA1 | 14973 |
| forkhead box A2 | FOXA2 | 14974 |
| forkhead box A3 | FOXA3 | 14975 |
| forkhead box B1 | FOXB1 | 14976 |
| forkhead box B2 | FOXB2 | 14977 |
| forkhead box C1 | FOXC1 | 14978 |
| forkhead box C2 | FOXC2 | 14979 |
| forkhead box D1 | FOXD1 | 14980 |
| forkhead box D2 | FOXD2 | 14981 |
| forkhead box D3 | FOXD3 | 14982 |
| forkhead box D4 | FOXD4 | 14983 |
| forkhead box D4-like 1 | FOXD4L1 | 14984 |
| forkhead box D4-like 3 | FOXD4L3 | 14985 |
| forkhead box D4-like 4 | FOXD4L4 | 14986 |
| forkhead box D4-like 5 | FOXD4L5 | 14987 |
| forkhead box D4-like 6 | FOXD4L6 | 14988 |
| forkhead box E1 | FOXE1 | 14989 |
| forkhead box E3 | FOXE3 | 14990 |
| forkhead box F1 | FOXF1 | 14991 |
| forkhead box F2 | FOXF2 | 14992 |
| forkhead box G1 | FOXG1 | 14993 |
| forkhead box H1 | FOXH1 | 14994 |
| forkhead box I1 | FOXI1 | 14995 |
| forkhead box I2 | FOXI2 | 14996 |
| forkhead box I3 | FOXI3 | 14997 |
| forkhead box J1 | FOXJ1 | 14998 |
| forkhead box J2 | FOXJ2 | 14999 |
| forkhead box J3 | FOXJ3 | 15000 |
| forkhead box K1 | FOXK1 | 15001 |
| forkhead box K2 | FOXK2 | 15002 |
| forkhead box L1 | FOXL1 | 15003 |
| forkhead box L2 | FOXL2 | 15004 |
| forkhead box M1 | FOXM1 | 15005 |
| forkhead box N1 | FOXN1 | 15006 |
| forkhead box N2 | FOXN2 | 15007 |
| forkhead box N3 | FOXN3 | 15008 |
| forkhead box N4 | FOXN4 | 15009 |
| forkhead box O1 | FOXO1 | 15010 |
| forkhead box O3 | FOXO3 | 15011 |
| forkhead box O4 | FOXO4 | 15012 |
| forkhead box O6 | FOXO6 | 15013 |
| forkhead box P1 | FOXP1 | 15014 |
| forkhead box P2 | FOXP3 | 15015 |
| forkhead box P3 | FOXP4 | 15016 |
| forkhead box P4 | FOXQ1 | 15017 |
| forkhead box Q1 | FOXR1 | 15018 |
| forkhead box R1 | FOXR2 | 15019 |
| forkhead box R2 | FOXS1 | 15020 |
| forkhead box S1 | FOXP3 | 15021 |
| far upstream element binding protein 1 | FUBP1 | 15022 |
| far upstream element (FUSE) binding protein 3 | FUBP3 | 15023 |
| GA binding protein transcription factor alpha subunit | GABPA | 15024 |
| GA binding protein transcription factor, beta subunit 1 | GABPB1 | 15025 |
| GA binding protein transcription factor, beta subunit 2 | GABPB2 | 15026 |
| GATA binding protein 1 (globin transcription factor 1) | GATA1 | 15027 |
| GATA binding protein 2 | GATA2 | 15028 |
| GATA binding protein 3 | GATA3 | 15029 |
| GATA binding protein 4 | GATA4 | 15030 |
| GATA binding protein 5 | GATA5 | 15031 |
| GATA binding protein 6 | GATA6 | 15032 |
| GATA zinc finger domain containing 1 | GATAD1 | 15033 |
| GATA zinc finger domain containing 2A | GATAD2A | 15034 |
| GATA zinc finger domain containing 2B | GATAD2B | 15035 |
| gastrulation brain homeobox 1 | GBX1 | 15036 |
| gastrulation brain homeobox 2 | GBX2 | 15037 |
| GC-rich sequence DNA-binding factor 2 | GCFC2 | 15038 |
| glial cells missing homolog 1 | GCM1 | 15039 |
| glial cells missing homolog 2 | GCM2 | 15040 |
| growth factor independent 1 transcription repressor | GFI1 | 15041 |

TABLE 4-continued

Exemplary Transcription Factors.

| Full Name | Abbreviation | SEQ ID NO: |
|---|---|---|
| growth factor independent 1B transcription repressor | GFI1B | 15042 |
| GLI family zinc finger 1 | GLI1 | 15043 |
| GLI family zinc finger 2 | GLI2 | 15044 |
| GLI family zinc finger 3 | GLI3 | 15045 |
| GLI family zinc finger 4 | GLI4 | 15046 |
| GLIS family zinc finger 1 | GLIS1 | 15047 |
| GLIS family zinc finger 2 | GLIS2 | 15048 |
| GLIS family zinc finger 3 | GLIS3 | 15049 |
| glucocorticoid modulatory element binding protein 1 | GMEB1 | 15050 |
| glucocorticoid modulatory element binding protein 2 | GMEB2 | 15051 |
| gon-4-like (*C. elegans*) | GON4L | 15052 |
| grainyhead like transcription factor 1 | GRHL1 | 15053 |
| grainyhead like transcription factor 2 | GRHL2 | 15054 |
| grainyhead like transcription factor 3 | GRHL3 | 15055 |
| goosecoid homeobox | GSC | 15056 |
| goosecoid homeobox 2 | GSC2 | 15057 |
| GS homeobox 1 | GSX1 | 15058 |
| GS homeobox 2 | GSX2 | 15059 |
| general transcription factor IIi | GTF2I | 15060 |
| general transcription factor IIIA | GTF3A | 15061 |
| GDNF inducible zinc finger protein 1 | GZF1 | 15062 |
| heart and neural crest derivatives expressed 1 | HAND1 | 15063 |
| heart and neural crest derivatives expressed 2 | HAND2 | 15064 |
| HMG-box transcription factor 1 | HBP1 | 15065-15066 |
| highly divergent homeobox | HDX | 15067 |
| helt bHLH transcription factor | HELT | 15068 |
| hes family bHLH transcription factor 1 | HES1 | 15069-15070 |
| hes family bHLH transcription factor 2 | HES2 | 15071 |
| hes family bHLH transcription factor 3 | HES3 | 15072 |
| hes family bHLH transcription factor 4 | HES4 | 15073 |
| hes family bHLH transcription factor 5 | HES5 | 15074 |
| hes family bHLH transcription factor 6 | HES6 | 15075 |
| hes family bHLH transcription factor 7 | HES7 | 15076 |
| HESX homeobox 1 | HESX1 | 15077 |
| hes-related family bHLH transcription factor with YRPW motif 1 | HEY1 | 15078 |
| hes-related family bHLH transcription factor with YRPW motif 2 | HEY2 | 15079 |
| hes-related family bHLH transcription factor with YRPW motif-like | HEYL | 15080 |
| hematopoietically expressed homeobox | HHEX | 15081 |
| hypermethylated in cancer 1 | HIC1 | 15082 |
| hypermethylated in cancer 2 | HIC2 | 15083 |
| hypoxia inducible factor 1, alpha subunit (basic helix-loop-helix transcription factor) | HIF1A | 15084 |
| hypoxia inducible factor 3, alpha subunit | HIF3A | 15085 |
| histone H4 transcription factor | HINFP | 15086 |
| human immunodeficiency virus type I enhancer binding protein 1 | HIVEP1 | 15087 |
| human immunodeficiency virus type I enhancer binding protein 2 | HIVEP2 | 15088 |
| human immunodeficiency virus type I enhancer binding protein 3 | HIVEP3 | 15089 |
| HKR1, GLI-Kruppel zinc finger family member | HKR1 | 15090 |
| hepatic leukemia factor | HLF | 15091 |
| helicase-like transcription factor | HLTF | 15092 |
| H2.0-like homeobox | HLX | 15093 |
| homeobox containing 1 | HMBOX1 | 15094 |
| high mobility group 20A | HMG20A | 15095 |
| high mobility group 20B | HMG20B | 15096 |
| high mobility group AT-hook 1 | HMGA1 | 15097 |
| high mobility group AT-hook 2 | HMGA2 | 15098 |
| HMG-box containing 3 | HMGXB3 | 15099 |
| HMG-box containing 4 | HMGXB4 | 15100 |
| H6 family homeobox 1 | HMX1 | 15101 |
| H6 family homeobox 2 | HMX2 | 15102 |
| H6 family homeobox 3 | HMX3 | 15103-15104 |
| HNF1 homeobox A | HNF1A | 15105 |
| HNF1 homeobox B | HNF1B | 15106 |
| hepatocyte nuclear factor 4 alpha | HNF4A | 15107 |
| hepatocyte nuclear factor 4 gamma | HNF4G | 15108 |
| heterogeneous nuclear ribonucleoprotein K | HNRNPK | 15109 |
| homeobox and leucine zipper encoding | HOMEZ | 15110 |
| HOP homeobox | HOPX | 15111 |
| homeobox A1 | HOXA1 | 15112 |
| homeobox A10 | HOXA10 | 15113 |

TABLE 4-continued

Exemplary Transcription Factors.

| Full Name | Abbreviation | SEQ ID NO: |
|---|---|---|
| homeobox A11 | HOXA11 | 15114 |
| homeobox A13 | HOXA13 | 15115 |
| homeobox A2 | HOXA2 | 15116 |
| homeobox A3 | HOXA3 | 15117 |
| homeobox A4 | HOXA4 | 15118 |
| homeobox A5 | HOXA5 | 15119 |
| homeobox A6 | HOXA6 | 15120 |
| homeobox A7 | HOXA7 | 15121 |
| homeobox A9 | HOXA9 | 15122 |
| homeobox B1 | HOXB1 | 15123 |
| homeobox B13 | HOXB13 | 15124 |
| homeobox B2 | HOXB2 | 15125 |
| homeobox B3 | HOXB3 | 15126 |
| homeobox B4 | HOXB4 | 15127 |
| homeobox B5 | HOXB5 | 15128 |
| homeobox B6 | HOXB6 | 15129 |
| homeobox B7 | HOXB7 | 15130 |
| homeobox B8 | HOXB8 | 15131 |
| homeobox B9 | HOXB9 | 15132 |
| homeobox C10 | HOXC10 | 15133 |
| homeobox C11 | HOXC11 | 15134 |
| homeobox C12 | HOXC12 | 15135 |
| homeobox C13 | HOXC13 | 15136 |
| homeobox C4 | HOXC4 | 15137 |
| homeobox C5 | HOXC5 | 15138 |
| homeobox C6 | HOXC6 | 15139 |
| homeobox C8 | HOXC8 | 15140 |
| homeobox C9 | HOXC9 | 15141 |
| homeobox D1 | HOXD1 | 15142 |
| homeobox D10 | HOXD10 | 15143 |
| homeobox D11 | HOXD11 | 15144 |
| homeobox D12 | HOXD12 | 15145 |
| homeobox D13 | HOXD13 | 15146 |
| homeobox D3 | HOXD3 | 15147 |
| homeobox D4 | HOXD4 | 15148 |
| homeobox D8 | HOXD8 | 15149 |
| homeobox D9 | HOXD9 | 15150 |
| heat shock transcription factor 1 | HSF1 | 15151 |
| heat shock transcription factor 2 | HSF2 | 15152 |
| heat shock transcription factor 4 | HSF4 | 15153 |
| heat shock transcription factor family member 5 | HSF5 | 15154 |
| heat shock transcription factor family, X-linked 1 | HSFX1 | 15155 |
| heat shock transcription factor, Y-linked 1 | HSFY1 | 15156 |
| heat shock transcription factor, Y-linked 2 | HSFY2 | 15156 |
| inhibitor of DNA binding 1, dominant negative helix-loop-helix protein | ID1 | 15157 |
| inhibitor of DNA binding 2, dominant negative helix-loop-helix protein | ID2 | 15158 |
| inhibitor of DNA binding 3, dominant negative helix-loop-helix protein | ID3 | 15159 |
| inhibitor of DNA binding 4, dominant negative helix-loop-helix protein | ID4 | 15160 |
| interferon, gamma-inducible protein 16 | IFI16 | 15161 |
| IKAROS family zinc finger 1 | IKZF1 | 15162 |
| IKAROS family zinc finger 2 | IKZF2 | 15163 |
| IKAROS family zinc finger 3 | IKZF3 | 15164 |
| IKAROS family zinc finger 4 | IKZF4 | 15165 |
| IKAROS family zinc finger 5 | IKZF5 | 15166 |
| insulinoma associated 1 | INSM1 | 15167 |
| insulinoma-associated 2 | INSM2 | 15168 |
| interferon regulatory factor 1 | IRF1 | 15169 |
| interferon regulatory factor 2 | IRF2 | 15170 |
| interferon regulatory factor 3 | IRF3 | 15171 |
| interferon regulatory factor 4 | IRF4 | 15172 |
| interferon regulatory factor 5 | IRF5 | 15173 |
| interferon regulatory factor 6 | IRF6 | 15174 |
| interferon regulatory factor 7 | IRF7 | 15175 |
| interferon regulatory factor 8 | IRF8 | 15176 |
| interferon regulatory factor 9 | IRF9 | 15177 |
| iroquois homeobox 1 | IRX1 | 15178 |
| iroquois homeobox 2 | IRX2 | 15179 |
| iroquois homeobox 3 | IRX3 | 15180 |
| iroquois homeobox 4 | IRX4 | 15181 |
| iroquois homeobox 5 | IRX5 | 15182 |
| iroquois homeobox 6 | IRX6 | 15183 |
| ISL LIM homeobox 1 | ISL1 | 15184 |

TABLE 4-continued

Exemplary Transcription Factors.

| Full Name | Abbreviation | SEQ ID NO: |
|---|---|---|
| ISL LIM homeobox 2 | ISL2 | 15185 |
| intestine specific homeobox | ISX | 15186 |
| jumonji and AT-rich interaction domain containing 2 | JARID2 | 15187 |
| JAZF zinc finger 1 | JAZF1 | 15188 |
| Jun dimerization protein 2 | JDP2 | 15189 |
| jun proto-oncogene | JUN | 15190 |
| jun B proto-oncogene | JUNB | 15191 |
| jun D proto-oncogene | JUND | 15192 |
| K(lysine) acetyltransferase 5 | KAT5 | 15193 |
| lysine acetyltransferase 6A | KAT6A | 15194 |
| lysine acetyltransferase 6B | KAT6B | 15195 |
| lysine acetyltransferase 7 | KAT7 | 15196 |
| lysine acetyltransferase 8 | KAT8 | 15197 |
| potassium channel modulatory factor 1 | KCMF1 | 15198 |
| potassium voltage-gated channel interacting protein 3 | KCNIP3 | 15199 |
| lysine demethylase 2A | KDM2A | 15200 |
| lysine demethylase 5A | KDM5A | 15201 |
| lysine demethylase 5B | KDM5B | 15202 |
| lysine demethylase 5C | KDM5C | 15203 |
| lysine demethylase 5D | KDM5D | 15204 |
| KH-type splicing regulatory protein | KHSRP | 15205 |
| KIAA1549 | KIAA1549 | 15206 |
| Kruppel-like factor 1 (erythroid) | KLF1 | 15207 |
| Kruppel-like factor 10 | KLF10 | 15208 |
| Kruppel-like factor 11 | KLF11 | 15209 |
| Kruppel-like factor 12 | KLF12 | 15210 |
| Kruppel-like factor 13 | KLF13 | 15211 |
| Kruppel-like factor 14 | KLF14 | 15212 |
| Kruppel-like factor 15 | KLF15 | 15213 |
| Kruppel-like factor 16 | KLF16 | 15214 |
| Kruppel-like factor 17 | KLF17 | 15215 |
| Kruppel-like factor 2 | KLF2 | 15216 |
| Kruppel-like factor 3 (basic) | KLF3 | 15217 |
| Kruppel-like factor 4 (gut) | KLF4 | 15218 |
| Kruppel-like factor 5 (intestinal) | KLF5 | 15219 |
| Kruppel-like factor 6 | KLF6 | 15220 |
| Kruppel-like factor 7 (ubiquitous) | KLF7 | 15221 |
| Kruppel-like factor 8 | KLF8 | 15222 |
| Kruppel-like factor 9 | KLF9 | 15223 |
| lysine methyltransferase 2A | KMT2A | 15224 |
| lysine methyltransferase 2B | KMT2B | 15225 |
| lysine methyltransferase 2C | KMT2C | 15226 |
| lysine methyltransferase 2E | KMT2E | 15227 |
| l(3)mbt-like 1 (*Drosophila*) | L3MBTL1 | 15228 |
| l(3)mbt-like 2 (*Drosophila*) | L3MBTL2 | 15229 |
| l(3)mbt-like 3 (*Drosophila*) | L3MBTL3 | 15230 |
| l(3)mbt-like 4 (*Drosophila*) | L3MBTL4 | 15231 |
| ladybird homeobox 1 | LBX1 | 15232 |
| ladybird homeobox 2 | LBX2 | 15233 |
| ligand dependent nuclear receptor corepressor | LCOR | 15234 |
| ligand dependent nuclear receptor corepressor like | LCORL | 15235 |
| lymphoid enhancer binding factor 1 | LEF1 | 15236 |
| leucine twenty homeobox | LEUTX | 15237 |
| LIM homeobox 1 | LHX1 | 15238 |
| LIM homeobox 2 | LHX2 | 15239 |
| LIM homeobox 3 | LHX3 | 15240 |
| LIM homeobox 4 | LHX4 | 15241 |
| LIM homeobox 5 | LHX5 | 15242 |
| LIM homeobox 6 | LHX6 | 15243 |
| LIM homeobox 8 | LHX8 | 15244 |
| LIM homeobox 9 | LHX9 | 15245 |
| LIM homeobox transcription factor 1, alpha | LMX1A | 15246 |
| LIM homeobox transcription factor 1, beta | LMX1B | 15247 |
| LOC730110 | LOC730110 | |
| leucine rich repeat (in FLII) interacting protein 1 | LRRFIP1 | 15248 |
| leucine rich repeat (in FLII) interacting protein 2 | LRRFIP2 | 15249 |
| Ly1 antibody reactive | LYAR | 15250 |
| lymphoblastic leukemia associated hematopoiesis regulator 1 | LYL1 | 15251 |
| maelstrom spermatogenic transposon silencer | MAEL | 15252 |
| v-maf avian musculoaponeurotic fibrosarcoma oncogene homolog | MAF | 15253 |
| MAF1 homolog, negative regulator of RNA polymerase III | MAF1 | 15254 |
| v-maf avian musculoaponeurotic fibrosarcoma oncogene homolog A | MAFA | 15255-15256 |

TABLE 4-continued

Exemplary Transcription Factors.

| Full Name | Abbreviation | SEQ ID NO: |
|---|---|---|
| v-maf avian musculoaponeurotic fibrosarcoma oncogene homolog B | MAFB | 15257 |
| v-maf avian musculoaponeurotic fibrosarcoma oncogene homolog F | MAFF | 15258 |
| v-maf avian musculoaponeurotic fibrosarcoma oncogene homolog G | MAFG | 15259 |
| v-maf avian musculoaponeurotic fibrosarcoma oncogene homolog K | MAFK | 15260 |
| matrin 3 | MATR3 | 15261 |
| MYC associated factor X | MAX | 15262 |
| MYC associated zinc finger protein | MAZ | 15263 |
| methyl-CpG binding domain protein 1 | MBD1 | 15264 |
| methyl-CpG binding domain protein 2 | MBD2 | 15265 |
| methyl-CpG binding domain protein 3 | MBD3 | 15266 |
| methyl-CpG binding domain protein 3-like 1 | MBD3L1 | 15267 |
| methyl-CpG binding domain protein 3-like 2 | MBD3L2 | 15268 |
| methyl-CpG binding domain 4 DNA glycosylase | MBD4 | 15269 |
| methyl-CpG binding domain protein 5 | MBD5 | 15270 |
| methyl-CpG binding domain protein 6 | MBD6 | 15271 |
| muscleblind like splicing regulator 3 | MBNL3 | 15272 |
| MDS1 and EVI1 complex locus | MECOM | 15273 |
| methyl-CpG binding protein 2 | MECP2 | 15274 |
| myocyte enhancer factor 2A | MEF2A | 15275 |
| myocyte enhancer factor 2B | MEF2B | 15276 |
| myocyte enhancer factor 2C | MEF2C | 15277 |
| myocyte enhancer factor 2D | MEF2D | 15278 |
| Meis homeobox 1 | MEIS1 | 15279 |
| Meis homeobox 2 | MEIS2 | 15280 |
| Meis homeobox 3 | MEIS3 | 15281 |
| Meis homeobox 3 pseudogene 1 | MEIS3P1 | 15282 |
| Meis homeobox 3 pseudogene 2 | MEIS3P2 | 15283 |
| mesenchyme homeobox 1 | MEOX1 | 15284 |
| mesenchyme homeobox 2 | MEOX2 | 15285 |
| mesoderm posterior bHLH transcription factor 1 | MESP1 | 15286 |
| mesoderm posterior bHLH transcription factor 2 | MESP2 | 15287 |
| MGA, MAX dimerization protein | MGA | 15288-15289 |
| MIER1 transcriptional regulator | MIER1 | 15290 |
| MIER family member 2 | MIER2 | 15291 |
| MIER family member 3 | MIER3 | 15292 |
| MIS18 binding protein 1 | MIS18BP1 | 15293 |
| microphthalmia-associated transcription factor | MITF | 15294 |
| Mix paired-like homeobox | MIXL1 | 15295 |
| mohawk homeobox | MKX | 15296 |
| myeloid/lymphoid or mixed-lineage leukemia; translocated to, 1 | MLLT1 | 15297 |
| myeloid/lymphoid or mixed-lineage leukemia; translocated to, 10 | MLLT10 | 15298 |
| myeloid/lymphoid or mixed-lineage leukemia; translocated to, 11 | MLLT11 | 15299 |
| myeloid/lymphoid or mixed-lineage leukemia; translocated to, 3 | MLLT3 | 15300 |
| myeloid/lymphoid or mixed-lineage leukemia; translocated to, 4 | MLLT4 | 15301 |
| myeloid/lymphoid or mixed-lineage leukemia; translocated to, 6 | MLLT6 | 15302 |
| MLX, MAX dimerization protein | MLX | 15303 |
| MLX interacting protein | MLXIP | 15304 |
| MLX interacting protein-like | MLXIPL | 15305 |
| MAX network transcriptional repressor | MNT | 15306 |
| motor neuron and pancreas homeobox 1 | MNX1 | 15307 |
| musculin | MSC | 15308 |
| mesogenin 1 | MSGN1 | 15309 |
| msh homeobox 1 | MSX1 | 15310 |
| msh homeobox 2 | MSX2 | 15311 |
| metastasis associated 1 | MTA1 | 15312 |
| metastasis associated 1 family member 2 | MTA2 | 15313 |
| metastasis associated 1 family member 3 | MTA3 | 15314 |
| metal-regulatory transcription factor 1 | MTF1 | 15315 |
| metal response element binding transcription factor 2 | MTF2 | 15316 |
| MAX dimerization protein 1 | MXD1 | 15317 |
| MAX dimerization protein 3 | MXD3 | 15318 |
| MAX dimerization protein 4 | MXD4 | 15319 |
| MAX interactor 1, dimerization protein | MXI1 | 15320 |
| v-myb avian myeloblastosis viral oncogene homolog | MYB | 15321 |
| v-myb avian myeloblastosis viral oncogene homolog-like 1 | MYBL1 | 15322 |

TABLE 4-continued

Exemplary Transcription Factors.

| Full Name | Abbreviation | SEQ ID NO: |
|---|---|---|
| v-myb avian myeloblastosis viral oncogene homolog-like 2 | MYBL2 | 15323 |
| v-myc avian myelocytomatosis viral oncogene homolog | MYC | 15324 |
| v-myc avian myelocytomatosis viral oncogene lung carcinoma derived homolog | MYCL | 15325 |
| MYCL pseudogene 1 | MYCLP1 | 15326 |
| v-myc avian myelocytomatosis viral oncogene neuroblastoma derived homolog | MYCN | 15327 |
| myogenic factor 5 | MYF5 | 15328 |
| myogenic factor 6 | MYF6 | 15329 |
| myoneurin | MYNN | 15330 |
| myogenic differentiation 1 | MYOD1 | 15331 |
| myogenin (myogenic factor 4) | MYOG | 15332 |
| myelin regulatory factor | MYRF | 15333 |
| Myb-like, SWIRM and MPN domains 1 | MYSM1 | 15334 |
| myelin transcription factor 1 | MYT1 | 15335-15336 |
| myelin transcription factor 1 like | MYT1L | 15337 |
| myeloid zinc finger 1 | MZF1 | 15338 |
| Nanog homeobox | NANOG | 15339 |
| NANOG neighbor homeobox | NANOGNB | 15340 |
| Nanog homeobox pseudogene 1 | NANOGP1 | 15341 |
| Nanog homeobox pseudogene 8 | NANOGP8 | 15342 |
| nuclear receptor coactivator 1 | NCOA1 | 15343 |
| nuclear receptor coactivator 2 | NCOA2 | 15344 |
| nuclear receptor coactivator 3 | NCOA3 | 15345 |
| nuclear receptor coactivator 4 | NCOA4 | 15346 |
| nuclear receptor coactivator 5 | NCOA5 | 15347 |
| nuclear receptor coactivator 6 | NCOA6 | 15348 |
| nuclear receptor coactivator 7 | NCOA7 | 15349 |
| nuclear receptor corepressor 1 | NCOR1 | 15350 |
| nuclear receptor corepressor 2 | NCOR2 | 15351 |
| neuronal differentiation 1 | NEUROD1 | 15352 |
| neuronal differentiation 2 | NEUROD2 | 15353 |
| neuronal differentiation 4 | NEUROD4 | 15354 |
| neuronal differentiation 6 | NEUROD6 | 15355 |
| neuro genin 1 | NEUROG1 | 15356 |
| neuro genin 2 | NEUROG2 | 15357 |
| neuro genin 3 | NEUROG3 | 15358 |
| nuclear factor of activated T-cells 5, tonicity-responsive | NFAT5 | 15359 |
| nuclear factor of activated T-cells, cytoplasmic, calcineurin-dependent 1 | NFATC1 | 15360 |
| nuclear factor of activated T-cells, cytoplasmic, calcineurin-dependent 2 | NFATC2 | 15361 |
| nuclear factor of activated T-cells, cytoplasmic, calcineurin-dependent 3 | NFATC3 | 15362 |
| nuclear factor of activated T-cells, cytoplasmic, calcineurin-dependent 4 | NFATC4 | 15363 |
| nuclear factor, erythroid 2 | NFE2 | 15364 |
| nuclear factor, erythroid 2 like 1 | NFE2L1 | 15365 |
| nuclear factor, erythroid 2 like 2 | NFE2L2 | 15366 |
| nuclear factor, erythroid 2 like 3 | NFE2L3 | 15367 |
| nuclear factor I/A | NFIA | 15368 |
| nuclear factor I/B | NFIB | 15369 |
| nuclear factor I/C (CCAAT-binding transcription factor) | NFIC | 15370 |
| nuclear factor, interleukin 3 regulated | NFIL3 | 15371 |
| nuclear factor I/X (CCAAT-binding transcription factor) | NFIX | 15372 |
| nuclear factor of kappa light polypeptide gene enhancer in B-cells 1 | NFKB1 | 15373 |
| nuclear factor of kappa light polypeptide gene enhancer in B-cells 2 (p49/p100) | NFKB2 | 15374 |
| nuclear factor of kappa light polypeptide gene enhancer in B-cells inhibitor, alpha | NFKBIA | 15375 |
| nuclear factor of kappa light polypeptide gene enhancer in B-cells inhibitor, beta | NFKBIB | 15376 |
| nuclear factor of kappa light polypeptide gene enhancer in B-cells inhibitor, delta | NFKBID | 15377 |
| nuclear factor of kappa light polypeptide gene enhancer in B-cells inhibitor, epsilon | NFKBIE | 15378 |
| nuclear factor of kappa light polypeptide gene enhancer in B-cells inhibitor-like 1 | NFKBIL1 | 15379 |
| nuclear factor of kappa light polypeptide gene enhancer in B-cells inhibitor, zeta | NFKBIZ | 15380 |

TABLE 4-continued

Exemplary Transcription Factors.

| Full Name | Abbreviation | SEQ ID NO: |
|---|---|---|
| nuclear factor related to kappaB binding protein | NFRKB | 15381 |
| nuclear transcription factor, X-box binding 1 | NFX1 | 15382 |
| nuclear transcription factor, X-box binding-like 1 | NFXL1 | 15383 |
| nuclear transcription factor Y subunit alpha | NFYA | 15384 |
| nuclear transcription factor Y subunit beta | NFYB | 15385 |
| nuclear transcription factor Y subunit gamma | NFYC | 15386 |
| nescient helix-loop-helix 1 | NHLH1 | 15387 |
| nescient helix-loop-helix 2 | NHLH2 | 15388 |
| NFKB repressing factor | NKRF | 15389 |
| NK1 homeobox 1 | NKX1-1 | 15390 |
| NK1 homeobox 2 | NKX1-2 | 15391 |
| NK2 homeobox 1 | NKX2-1 | 15392 |
| NK2 homeobox 2 | NKX2-2 | 15393 |
| NK2 homeobox 3 | NKX2-3 | 15394 |
| NK2 homeobox 4 | NKX2-4 | 15395 |
| NK2 homeobox 5 | NKX2-5 | 15396 |
| NK2 homeobox 6 | NKX2-6 | 15397 |
| NK2 homeobox 8 | NKX2-8 | 15398 |
| NK3 homeobox 1 | NKX3-1 | 15399 |
| NK3 homeobox 2 | NKX3-2 | 15400 |
| NK6 homeobox 1 | NKX6-1 | 15401 |
| NK6 homeobox 2 | NKX6-2 | 15402 |
| NK6 homeobox 3 | NKX6-3 | 15403 |
| NOBOX oogenesis homeobox | NOBOX | 15404 |
| NOC3 like DNA replication regulator | NOC3L | 15405 |
| nucleolar complex associated 4 homolog | NOC4L | 15406 |
| non-POU domain containing, octamer-binding | NONO | 15407 |
| notochord homeobox | NOTO | 15408 |
| neuronal PAS domain protein 1 | NPAS1 | 15409 |
| neuronal PAS domain protein 2 | NPAS2 | 15410 |
| neuronal PAS domain protein 3 | NPAS3 | 15411 |
| neuronal PAS domain protein 4 | NPAS4 | 15412 |
| nuclear receptor subfamily 0 group B member 1 | NR0B1 | 15413 |
| nuclear receptor subfamily 0 group B member 2 | NR0B2 | 15414 |
| nuclear receptor subfamily 1 group D member 1 | NR1D1 | 15415 |
| nuclear receptor subfamily 1 group D member 2 | NR1D2 | 15416 |
| nuclear receptor subfamily 1 group H member 2 | NR1H2 | 15417 |
| nuclear receptor subfamily 1 group H member 3 | NR1H3 | 15418 |
| nuclear receptor subfamily 1 group H member 4 | NR1H4 | 15419 |
| nuclear receptor subfamily 1 group I member 2 | NR1I2 | 15420 |
| nuclear receptor subfamily 1 group I member 3 | NR1I3 | 15421 |
| nuclear receptor subfamily 2 group C member 1 | NR2C1 | 15422 |
| nuclear receptor subfamily 2 group C member 2 | NR2C2 | 15423 |
| nuclear receptor subfamily 2 group E member 1 | NR2E1 | 15424 |
| nuclear receptor subfamily 2 group E member 3 | NR2E3 | 15425 |
| nuclear receptor subfamily 2 group F member 1 | NR2F1 | 15426 |
| nuclear receptor subfamily 2 group F member 2 | NR2F2 | 15427 |
| nuclear receptor subfamily 2 group F member 6 | NR2F6 | 15428 |
| nuclear receptor subfamily 3 group C member 1 | NR3C1 | 15429 |
| nuclear receptor subfamily 3 group C member 2 | NR3C2 | 15430 |
| nuclear receptor subfamily 4 group A member 1 | NR4A1 | 15431 |
| nuclear receptor subfamily 4 group A member 2 | NR4A2 | 15432 |
| nuclear receptor subfamily 4 group A member 3 | NR4A3 | 15433 |
| nuclear receptor subfamily 5 group A member 1 | NR5A1 | 15434 |
| nuclear receptor subfamily 5 group A member 2 | NR5A2 | 15435 |
| nuclear receptor subfamily 6 group A member 1 | NR6A1 | 15436 |
| nuclear respiratory factor 1 | NRF1 | 15437-15438 |
| neural retina leucine zipper | NRL | 15439 |
| oligodendrocyte transcription factor 1 | OLIG1 | 15440 |
| oligodendrocyte lineage transcription factor 2 | OLIG2 | 15441 |
| oligodendrocyte transcription factor 3 | OLIG3 | 15442 |
| one cut homeobox 1 | ONECUT1 | 15443 |
| one cut homeobox 2 | ONECUT2 | 15444 |
| one cut homeobox 3 | ONECUT3 | 15445 |
| odd-skipped related transcription factor 1 | OSR1 | 15446 |
| odd-skipped related transcription factor 2 | OSR2 | 15447 |
| orthopedia homeobox | OTP | 15448 |
| orthodenticle homeobox 1 | OTX1 | 15449 |
| orthodenticle homeobox 2 | OTX2 | 15450 |
| ovo like zinc finger 1 | OVOL1 | 15451 |
| ovo like zinc finger 2 | OVOL2 | 15452 |
| ovo like zinc finger 3 | OVOL3 | 15453 |
| poly(ADP-ribose) polymerase 1 | PARP1 | 15454 |
| poly(ADP-ribose) polymerase family member 12 | PARP12 | 15455 |
| POZ/BTB and AT hook containing zinc finger 1 | PATZ1 | 15456 |
| PRKC, apoptosis, WT1, regulator | PAWR | 15457 |

TABLE 4-continued

Exemplary Transcription Factors.

| Full Name | Abbreviation | SEQ ID NO: |
|---|---|---|
| paired box 1 | PAX1 | 15458 |
| paired box 2 | PAX2 | 15459 |
| paired box 3 | PAX3 | 15460 |
| paired box 4 | PAX4 | 15461 |
| paired box 5 | PAX5 | 15462 |
| paired box 6 | PAX6 | 15463 |
| paired box 7 | PAX7 | 15464 |
| paired box 8 | PAX8 | 15465 |
| paired box 9 | PAX9 | 15466 |
| PAX3 and PAX7 binding protein 1 | PAXBP1 | 15467 |
| polybromo 1 | PBRM1 | 15468 |
| pre-B-cell leukemia homeobox 1 | PBX1 | 15469 |
| pre-B-cell leukemia homeobox 2 | PBX2 | 15470 |
| pre-B-cell leukemia homeobox 3 | PBX3 | 15471 |
| pre-B-cell leukemia homeobox 4 | PBX4 | 15472 |
| poly(rC) binding protein 1 | PCBP1 | 15473 |
| poly(rC) binding protein 2 | PCBP2 | 15474 |
| poly(rC) binding protein 3 | PCBP3 | 15475 |
| poly(rC) binding protein 4 | PCBP4 | 15476 |
| poly comb group ring finger 6 | PCGF6 | 15477 |
| pancreatic and duodenal homeobox 1 | PDX1 | 15478-15479 |
| paternally expressed 3 | PEG3 | 15480 |
| progesterone receptor | PGR | 15481 |
| prohibitin | PHB | 15482 |
| prohibitin 2 | PHB2 | 15483 |
| PHD finger protein 20 | PHF20 | 15484 |
| PHD finger protein 5A | PHF5A | 15485 |
| paired like homeobox 2a | PHOX2A | 15486 |
| paired like homeobox 2b | PHOX2B | 15487 |
| putative homeodomain transcription factor 1 | PHTF1 | 15488 |
| putative homeodomain transcription factor 2 | PHTF2 | 15489 |
| paired like homeodomain 1 | PITX1 | 15490 |
| paired like homeodomain 2 | PITX2 | 15491 |
| paired like homeodomain 3 | PITX3 | 15492 |
| PBX/knotted 1 homeobox 1 | PKNOX1 | 15493 |
| PBX/knotted 1 homeobox 2 | PKNOX2 | 15494 |
| PLAG1 zinc finger | PLAG1 | 15495 |
| PLAG1 like zinc finger 1 | PLAGL1 | 15496 |
| PLAG1 like zinc finger 2 | PLAGL2 | 15497 |
| pleckstrin | PLEK | 15498 |
| promyelocytic leukaemia zinc finger | PLZF | 15499 |
| pogo transposable element with ZNF domain | POGZ | 15500 |
| POU class 1 homeobox 1 | POU1F1 | 15501 |
| POU class 2 associating factor 1 | POU2AF1 | 15502 |
| POU class 2 homeobox 1 | POU2F1 | 15503 |
| POU class 2 homeobox 2 | POU2F2 | 15504 |
| POU class 2 homeobox 3 | POU2F3 | 15505 |
| POU class 3 homeobox 1 | POU3F1 | 15506 |
| POU class 3 homeobox 2 | POU3F2 | 15507 |
| POU class 3 homeobox 3 | POU3F3 | 15508 |
| POU class 3 homeobox 4 | POU3F4 | 15509 |
| POU class 4 homeobox 1 | POU4F1 | 15510 |
| POU class 4 homeobox 2 | POU4F2 | 15511 |
| POU class 4 homeobox 3 | POU4F3 | 15512 |
| POU class 5 homeobox 1 | POU5F1 | 15513 |
| POU class 5 homeobox 1B | POU5F1B | 15514 |
| POU domain class 5, transcription factor 2 | POU5F2 | 15515 |
| POU class 6 homeobox 1 | POU6F1 | 15516 |
| POU class 6 homeobox 2 | POU6F2 | 15517 |
| peroxisome proliferator activated receptor alpha | PPARA | 15518 |
| peroxisome proliferator activated receptor delta | PPARD | 15519 |
| peroxisome proliferator activated receptor gamma | PPARG | 15520 |
| protein phosphatase 1 regulatory subunit 13 like | PPP1R13L | 15521 |
| PR domain 1 | PRDM1 | 15522 |
| PR domain 10 | PRDM10 | 15523 |
| PR domain 11 | PRDM11 | 15524 |
| PR domain 12 | PRDM12 | 15525 |
| PR domain 13 | PRDM13 | 15526 |
| PR domain 14 | PRDM14 | 15527 |
| PR domain 15 | PRDM15 | 15528 |
| PR domain 16 | PRDM16 | 15529 |
| PR domain 2 | PRDM2 | 15530 |
| PR domain 4 | PRDM4 | 15531 |
| PR domain 5 | PRDM5 | 15532 |
| PR domain 6 | PRDM6 | 15533 |
| PR domain 7 | PRDM7 | 15534 |

TABLE 4-continued

Exemplary Transcription Factors.

| Full Name | Abbreviation | SEQ ID NO: |
|---|---|---|
| PR domain 8 | PRDM8 | 15535 |
| PR domain 9 | PRDM9 | 15536 |
| prolactin regulatory element binding | PREB | 15537 |
| PROP paired-like homeobox 1 | PROP1 | 15538 |
| prospero homeobox 1 | PROX1 | 15539 |
| prospero homeobox 2 | PROX2 | 15540 |
| paired related homeobox 1 | PRRX1 | 15541 |
| paired related homeobox 2 | PRRX2 | 15542 |
| paraspeckle component 1 | PSPC1 | 15543 |
| pancreas specific transcription factor, 1a | PTF1A | 15544 |
| purine-rich element binding protein A | PURA | 15545 |
| purine-rich element binding protein B | PURB | 15546 |
| purine-rich element binding protein G | PURG | 15547 |
| retinoic acid receptor alpha | RARA | 15548 |
| retinoic acid receptor beta | RARB | 15549 |
| retinoic acid receptor gamma | RARG | 15550 |
| retina and anterior neural fold homeobox | RAX | 15551-15552 |
| retina and anterior neural fold homeobox 2 | RAX2 | 15553 |
| RB associated KRAB zinc finger | RBAK | 15554 |
| RNA binding motif protein 22 | RBM22 | 15555 |
| recombination signal binding protein for immunoglobulin kappa J region | RBPJ | 15556 |
| recombination signal binding protein for immunoglobulin kappa J region-like | RBPJL | 15557 |
| ring finger and CCCH-type domains 1 | RC3H1 | 15558 |
| ring finger and CCCH-type domains 2 | RC3H2 | 15559 |
| REST corepressor 1 | RCOR1 | 15560 |
| REST corepressor 2 | RCOR2 | 15561 |
| REST corepressor 3 | RCOR3 | 15562 |
| v-rel avian reticuloendothcliosis viral oncogene homolog | REL | 15563 |
| v-rel avian reticuloendothcliosis viral oncogene homolog A | RELA | 15564 |
| v-rel avian reticuloendothcliosis viral oncogene homolog B | RELB | 15565 |
| arginine-glutamic acid di peptide (RE) repeats | RERE | 15566 |
| RE1-silencing transcription factor | REST | 15567 |
| regulatory factor X1 | RFX1 | 15568 |
| regulatory factor X2 | RFX2 | 15569 |
| regulatory factor X3 | RFX3 | 15570 |
| regulatory factor X4 | RFX4 | 15571 |
| regulatory factor X5 | RFX5 | 15572 |
| regulatory factor X6 | RFX6 | 15573 |
| regulatory factor X7 | RFX7 | 15574 |
| RFX family member 8, lacking RFX DNA binding domain | RFX8 | 15575 |
| regulatory factor X associated ankyrin containing protein | RFXANK | 15576 |
| regulatory factor X associated protein | RFXAP | 15577 |
| Rhox homeobox family member 1 | RHOXF1 | 15578 |
| Rhox homeobox family member 2 | RHOXF2 | 15579 |
| Rhox homeobox family member 2B | RHOXF2B | 15580 |
| rearranged L-myc fusion | RLF | 15581-15582 |
| RAR related orphan receptor A | RORA | 15583 |
| RAR related orphan receptor B | RORB | 15584 |
| RAR related orphan receptor C | RORC | 15585 |
| retinoic acid receptor-related orphan nuclear receptor gamma | RORgT | 15586 |
| ras responsive element binding protein 1 | RREB1 | 15587 |
| runt related transcription factor 1 | RUNX1 | 15588 |
| runt related transcription factor 1; translocated to, 1 (cyclin D related) | RUNX1T1 | 15589 |
| runt related transcription factor 2 | RUNX2 | 15590 |
| runt related transcription factor 3 | RUNX3 | 15591 |
| retinoid X receptor alpha | RXRA | 15592 |
| retinoid X receptor beta | RXRB | 15593 |
| retinoid X receptor gamma | RXRG | 15594 |
| spalt-like transcription factor 1 | SALL1 | 15595 |
| spalt-like transcription factor 2 | SALL2 | 15596 |
| spalt-like transcription factor 3 | SALL3 | 15597 |
| spalt-like transcription factor 4 | SALL4 | 15598 |
| SATB homeobox 1 | SATB1 | 15599 |
| SATB homeobox 2 | SATB2 | 15600 |
| S-phase cyclin A-associated protein in the ER | SCAPER | 15601 |
| scratch family zinc finger 1 | SCRT1 | 15602 |
| scratch family zinc finger 2 | SCRT2 | 15603 |

TABLE 4-continued

Exemplary Transcription Factors.

| Full Name | Abbreviation | SEQ ID NO: |
|---|---|---|
| scleraxis bHLH transcription factor | SCX | 15604 |
| SEBOX homeobox | SEBOX | 15605 |
| SET binding protein 1 | SETBP1 | 15606 |
| splicing factor proline/glutamine-rich | SFPQ | 15607 |
| short stature homeobox | SHOX | 15608 |
| short stature homeobox 2 | SHOX2 | 15609 |
| single-minded family bHLH transcription factor 1 | SIM1 | 15610 |
| single-minded family bHLH transcription factor 2 | SIM2 | 15611 |
| SIX homeobox 1 | SIX1 | 15612 |
| SIX homeobox 2 | SIX2 | 15613 |
| SIX homeobox 3 | SIX3 | 15614 |
| SIX homeobox 4 | SIX4 | 15615 |
| SIX homeobox 5 | SIX5 | 15616 |
| SIX homeobox 6 | SIX6 | 15617 |
| SKI proto-oncogene | SKI | 15618 |
| SKI-like proto-oncogene | SKIL | 15619 |
| SKI family transcriptional corepressor 1 | SKOR1 | 15620 |
| SKI family transcriptional corepressor 2 | SKOR2 | 15621 |
| solute carrier family 30 (zinc transporter), member 9 | SLC30A9 | 15622 |
| SMAD family member 1 | SMAD1 | 15623 |
| SMAD family member 2 | SMAD2 | 15624 |
| SMAD family member 3 | SMAD3 | 15625 |
| SMAD family member 4 | SMAD4 | 15626 |
| SMAD family member 5 | SMAD5 | 15627 |
| SMAD family member 6 | SMAD6 | 15628 |
| SMAD family member 7 | SMAD7 | 15629 |
| SMAD family member 9 | SMAD9 | 15630 |
| SWI/SNF related, matrix associated, actin dependent regulator of chromatin, subfamily a, member 1 | SMARCA1 | 15631 |
| SWI/SNF related, matrix associated, actin dependent regulator of chromatin, subfamily a, member 2 | SMARCA2 | 15632 |
| SWI/SNF related, matrix associated, actin dependent regulator of chromatin, subfamily a, member 4 | SMARCA4 | 15633 |
| SWI/SNF related, matrix associated, actin dependent regulator of chromatin, subfamily a, member 5 | SMARCA5 | 15634 |
| SWI/SNF-related, matrix-associated actin-dependent regulator of chromatin, subfamily a, containing DEAD/H box 1 | SMARCAD1 | 15635 |
| SWI/SNF related, matrix associated, actin dependent regulator of chromatin, subfamily a-like 1 | SMARCAL1 | 15636 |
| SWI/SNF related, matrix associated, actin dependent regulator of chromatin, subfamily b, member 1 | SMARCB1 | 15637 |
| SWI/SNF related, matrix associated, actin dependent regulator of chromatin, subfamily c, member 1 | SMARCC1 | 15638 |
| SWI/SNF related, matrix associated, actin dependent regulator of chromatin, subfamily c, member 2 | SMARCC2 | 15639 |
| SWI/SNF related, matrix associated, actin dependent regulator of chromatin, subfamily d, member 1 | SMARCD1 | 15640 |
| SWI/SNF related, matrix associated, actin dependent regulator of chromatin, subfamily d, member 2 | SMARCD2 | 15641 |
| SWI/SNF related, matrix associated, actin dependent regulator of chromatin, subfamily d, member 3 | SMARCD3 | 15642 |
| SWI/SNF related, matrix associated, actin dependent regulator of chromatin, subfamily e, member 1 | SMARCE1 | 15643 |
| snail family zinc finger 1 | SNAI1 | 15644 |
| snail family zinc finger 2 | SNAI2 | 15645 |
| snail family zinc finger 3 | SNAI3 | 15646 |
| small nuclear RNA activating complex polypeptide 4 | SNAPC4 | 15647 |
| spermatogenesis and oogenesis specific basic helix-loop-helix 1 | SOHLH1 | 15648 |
| spermatogenesis and oogenesis specific basic helix-loop-helix 2 | SOHLH2 | 15649 |
| SRY-box 1 | SOX1 | 15650 |
| SRY-box 10 | SOX10 | 15651 |
| SRY-box 11 | SOX11 | 15652 |
| SRY-box 12 | SOX12 | 15653 |
| SRY-box 13 | SOX13 | 15654 |
| SRY-box 14 | SOX14 | 15655 |
| SRY-box 15 | SOX15 | 15656 |
| SRY-box 17 | SOX17 | 15657 |
| SRY-box 18 | SOX18 | 15658 |
| SRY-box 2 | SOX2 | 15659 |
| SRY-box 21 | SOX21 | 15660 |
| SRY-box 3 | SOX3 | 15661 |
| SRY-box 30 | SOX30 | 15662 |
| SRY-box 4 | SOX4 | 15663 |

TABLE 4-continued

Exemplary Transcription Factors.

| Full Name | Abbreviation | SEQ ID NO: |
|---|---|---|
| SRY-box 5 | SOX5 | 15664 |
| SRY-box 6 | SOX6 | 15665 |
| SRY-box 7 | SOX7 | 15666 |
| SRY-box 8 | SOX8 | 15667 |
| SRY-box 9 | SOX9 | 15668 |
| Sp1 transcription factor | SP1 | 15669-15670 |
| SP100 nuclear antigen | SP100 | 15671 |
| SP110 nuclear body protein | SP110 | 15672 |
| SP140 nuclear body protein | SP140 | 15673 |
| SP140 nuclear body protein like | SP140L | 15674 |
| Sp2 transcription factor | SP2 | 15675 |
| Sp3 transcription factor | SP3 | 15676 |
| Sp4 transcription factor | SP4 | 15677 |
| Sp5 transcription factor | SP5 | 15678 |
| Sp6 transcription factor | SP6 | 15679 |
| Sp7 transcription factor | SP7 | 15680 |
| Sp8 transcription factor | SP8 | 15681 |
| Sp9 transcription factor | SP9 | 15682 |
| SAM pointed domain containing ETS transcription factor | SPDEF | 15683 |
| Spi-1 proto-oncogene | SPI1 | 15684 |
| Spi-B transcription factor (Spi-1/PU.1 related) | SPIB | 15685 |
| Spi-C transcription factor (Spi-1/PU.1 related) | SPIC | 15686 |
| spermatogenic leucine zipper 1 | SPZ1 | 15687 |
| sterol regulatory element binding transcription factor 1 | SREBF1 | 15688 |
| sterol regulatory element binding transcription factor 2 | SREBF2 | 15689 |
| serum response factor | SRF | 15690 |
| sex determining region Y | SRY | 15691 |
| structure specific recognition protein 1 | SSRP1 | 15692 |
| suppression of tumorigenicity 18, zinc finger | ST18 | 15693 |
| signal transducer and activator of transcription 1 | STAT1 | 15694 |
| signal transducer and activator of transcription 2 | STAT2 | 15695 |
| signal transducer and activator of transcription 3 (acute-phase response factor) | STAT3 | 15696 |
| signal transducer and activator of transcription 4 | STAT4 | 15697 |
| signal transducer and activator of transcription 5 | STAT5 | 15698 |
| signal transducer and activator of transcription 5A | STAT5A | 15699 |
| signal transducer and activator of transcription 5B | STAT5B | 15700 |
| signal transducer and activator of transcription 6, interleukin-4 induced | STAT6 | 15701 |
| transcriptional adaptor 2A | TADA2A | 15702 |
| transcriptional adaptor 2B | TADA2B | 15703 |
| TATA-box binding protein associated factor 1 | TAF1 | 15704 |
| T-cell acute lymphocytic leukemia 1 | TAL1 | 15705 |
| T-cell acute lymphocytic leukemia 2 | TAL2 | 15706 |
| Tax1 (human T-cell leukemia virus type I) binding protein 1 | TAX1BP1 | 15707 |
| Tax1 (human T-cell leukemia virus type I) binding protein 3 | TAX1BP3 | 15708 |
| T-box transcription factor T-bet | Tbet | 15709 |
| TATA-box binding protein | TBP | 15710 |
| TATA-box binding protein like 1 | TBPL1 | 15711 |
| TATA-box binding protein like 2 | TBPL2 | 15712 |
| T-box, brain 1 | TBR1 | 15713 |
| T-box 1 | TBX1 | 15714 |
| T-box 10 | TBX10 | 15715 |
| T-box 15 | TBX15 | 15716 |
| T-box 18 | TBX18 | 15717 |
| T-box 19 | TBX19 | 15718 |
| T-box 2 | TBX2 | 15719 |
| T-box 20 | TBX20 | 15720 |
| T-box 21 | TBX21 | 15721 |
| T-box 22 | TBX22 | 15722 |
| T-box 3 | TBX3 | 15723 |
| T-box 4 | TBX4 | 15724 |
| T-box 5 | TBX5 | 15725 |
| T-box 6 | TBX6 | 15726 |
| transcription factor 12 | TCF12 | 15727 |
| transcription factor 15 (basic helix-loop-helix) | TCF15 | 15728 |
| transcription factor 19 | TCF19 | 15729 |
| transcription factor 20 (AR1) | TCF20 | 15730 |
| transcription factor 21 | TCF21 | 15731 |
| transcription factor 23 | TCF23 | 15732 |
| transcription factor 24 | TCF24 | 15733 |
| transcription factor 25 (basic helix-loop-helix) | TCF25 | 15734 |
| transcription factor 3 | TCF3 | 15735 |

TABLE 4-continued

Exemplary Transcription Factors.

| Full Name | Abbreviation | SEQ ID NO: |
|---|---|---|
| transcription factor 4 | TCF4 | 15736 |
| transcription factor 7 (T-cell specific, HMG-box, TCF1) | TCF7 | 15737 |
| transcription factor 7 like 1 | TCF7L1 | 15738 |
| transcription factor 7 like 2 | TCF7L2 | 15739 |
| transcription factor-like 5 (basic helix-loop-helix) | TCFL5 | 15740 |
| TEA domain transcription factor 1 | TEAD1 | 15741 |
| TEA domain transcription factor 2 | TEAD2 | 15742 |
| TEA domain transcription factor 3 | TEAD3 | 15743 |
| TEA domain transcription factor 4 | TEAD4 | 15744 |
| thyrotrophic embryonic factor | TEF | 15745 |
| telomeric repeat binding factor (NIMA-interacting) 1 | TERF1 | 15746 |
| telomeric repeat binding factor 2 | TERF2 | 15747 |
| tet methylcytosine dioxygenase 1 | TET1 | 15748 |
| tet methylcytosine dioxygenase 2 | TET2 | 15749 |
| tet methylcytosine dioxygenase 3 | TET3 | 15750 |
| transcription factor A, mitochondrial | TFAM | 15751 |
| transcription factor AP-2 alpha (activating enhancer binding protein 2 alpha) | TFAP2A | 15752 |
| transcription factor AP-2 beta (activating enhancer binding protein 2 beta) | TFAP2B | 15753 |
| transcription factor AP-2 gamma (activating enhancer binding protein 2 gamma) | TFAP2C | 15754 |
| transcription factor AP-2 delta (activating enhancer binding protein 2 delta) | TFAP2D | 15755 |
| transcription factor AP-2 epsilon (activating enhancer binding protein 2 epsilon) | TFAP2E | 15756 |
| transcription factor AP-4 (activating enhancer binding protein 4) | TFAP4 | 15757 |
| transcription factor B1, mitochondrial | TFB1M | 15758 |
| transcription factor B2, mitochondrial | TFB2M | 15759 |
| transcription factor CP2 | TFCP2 | 15760 |
| transcription factor CP2-like 1 | TFCP2L1 | 15761 |
| transcription factor Dp-1 | TFDP1 | 15762 |
| transcription factor Dp-2 (E2F dimerization partner 2) | TFDP2 | 15763 |
| transcription factor Dp family member 3 | TFDP3 | 15764 |
| transcription factor binding to IGHM enhancer 3 | TFE3 | 15765 |
| transcription factor EB | TFEB | 15766 |
| transcription factor EC | TFEC | 15767 |
| TGFB induced factor homeobox 1 | TGIF1 | 15768 |
| TGFB induced factor homeobox 2 | TGIF2 | 15769 |
| TGFB induced factor homeobox 2 like, X-linked | TGIF2LX | 15770 |
| TGFB induced factor homeobox 2 like, Y-linked | TGIF2LY | 15771 |
| THAP domain containing, apoptosis associated protein 1 | THAP1 | 15772 |
| THAP domain containing 10 | THAP10 | 15773 |
| THAP domain containing 11 | THAP11 | 15774 |
| THAP domain containing 12 | THAP12 | 15775 |
| THAP domain containing, apoptosis associated protein 2 | THAP2 | 15776 |
| THAP domain containing, apoptosis associated protein 3 | THAP3 | 15777 |
| THAP domain containing 4 | THAP4 | 15778 |
| THAP domain containing 5 | THAP5 | 15779 |
| THAP domain containing 6 | THAP6 | 15780 |
| THAP domain containing 7 | THAP7 | 15781 |
| THAP domain containing 8 | THAP8 | 15782 |
| THAP domain containing 9 | THAP9 | 15783 |
| Th inducing POZ-Kruppel Factor | ThPOK | 15784 |
| thyroid hormone receptor, alpha | THRA | 15785 |
| thyroid hormone receptor, beta | THRB | 15786 |
| T-cell leukemia homeobox 1 | TLX1 | 15787 |
| T-cell leukemia homeobox 2 | TLX2 | 15788 |
| T-cell leukemia homeobox 3 | TLX3 | 15789 |
| target of EGR1, member 1 (nuclear) | TOE1 | 15790 |
| tonsoku-like, DNA repair protein | TONSL | 15791 |
| topoisomerase I binding, arginine/serine-rich, E3 ubiquitin protein ligase | TOPORS | 15792 |
| thymocyte selection associated high mobility group box | TOX | 15793 |
| TOX high mobility group box family member 2 | TOX2 | 15794 |
| TOX high mobility group box family member 3 | TOX3 | 15795 |
| TOX high mobility group box family member 4 | TOX4 | 15796 |
| tumor protein p53 | TP53 | 15797 |
| tumor protein p63 | TP63 | 15798 |
| tumor protein p73 | TP73 | 15799 |

TABLE 4-continued

Exemplary Transcription Factors.

| Full Name | Abbreviation | SEQ ID NO: |
|---|---|---|
| tetra-peptide repeat homeobox 1 | TPRX1 | 15800 |
| tetra-peptide repeat homeobox-like | TPRXL | 15801 |
| transcriptional regulating factor 1 | TRERF1 | 15802 |
| trichorhinophalangeal syndrome I | TRPS1 | 15803 |
| TSC22 domain family member 1 | TSC22D1 | 15804 |
| TSC22 domain family member 2 | TSC22D2 | 15805 |
| TSC22 domain family member 3 | TSC22D3 | 15806 |
| TSC22 domain family member 4 | TSC22D4 | 15807 |
| teashirt zinc finger homeobox 1 | TSHZ1 | 15808 |
| teashirt zinc finger homeobox 2 | TSHZ2 | 15809 |
| teashirt zinc finger homeobox 3 | TSHZ3 | 15810 |
| transcription termination factor, RNA polymerase I | TTF1 | 15811-15812 |
| transcription termination factor, RNA polymerase II | TTF2 | 15813-15814 |
| tubby bipartite transcription factor | TUB | 15815 |
| twist family bHLH transcription factor 1 | TWIST1 | 15816 |
| twist family bHLH transcription factor 2 | TWIST2 | 15817 |
| upstream binding protein 1 (LBP-1a) | UBP1 | 15818 |
| upstream binding transcription factor, RNA polymerase I | UBTF | 15819 |
| upstream binding transcription factor, RNA polymerase I-like 1 | UBTFL1 | 15820 |
| upstream binding transcription factor, RNA polymerase I-like 6 (pseudogene) | UBTFL6 | 15821 |
| UNC homeobox | UNCX | 15822 |
| unkempt family zinc finger | UNK | 15823 |
| unkempt family like zinc finger | UNKL | 15824 |
| upstream transcription factor 1 | USF1 | 15825 |
| upstream transcription factor 2, c-fos interacting | USF2 | 15826 |
| upstream transcription factor family member 3 | USF3 | 15827 |
| undifferentiated embryonic cell transcription factor 1 | UTF1 | 15828 |
| ventral anterior homeobox 1 | VAX1 | 15829 |
| ventral anterior homeobox 2 | VAX2 | 15830 |
| vitamin D (1,25-dihydroxyvitamin D3) receptor | VDR | 15831 |
| VENT homeobox | VENTX | 15832 |
| vascular endothelial zinc finger 1 | VEZF1 | 15833 |
| visual system homeobox 1 | VSX1 | 15834 |
| visual system homeobox 2 | VSX2 | 15835 |
| WD repeat and HMG-box DNA binding protein 1 | WDHD1 | 15836 |
| Wolf-Hirschhorn syndrome candidate 1 | WHSC1 | 15837 |
| widely interspaced zinc finger motifs | WIZ | 15838 |
| Wilms tumor 1 | WT1 | 15839 |
| X-box binding protein 1 | XBP1 | 15840 |
| Y-box binding protein 1 | YBX1 | 15841 |
| Y-box binding protein 2 | YBX2 | 15842 |
| Y-box binding protein 3 | YBX3 | 15843 |
| YEATS domain containing 2 | YEATS2 | 15844 |
| YEATS domain containing 4 | YEATS4 | 15845 |
| YY1 transcription factor | YY1 | 15846 |
| YY2 transcription factor | YY2 | 15847 |
| zinc finger BED-type containing 1 | ZBED1 | 15848 |
| zinc finger BED-type containing 2 | ZBED2 | 15849 |
| zinc finger BED-type containing 3 | ZBED3 | 15850 |
| zinc finger BED-type containing 4 | ZBED4 | 15851 |
| zinc finger BED-type containing 5 | ZBED5 | 15852 |
| zinc finger, BED-type containing 6 | ZBED6 | 15853 |
| Z-DNA binding protein 1 | ZBP1 | 15854-15855 |
| zinc finger and BTB domain containing 1 | ZBTB1 | 15856 |
| zinc finger and BTB domain containing 10 | ZBTB10 | 15857 |
| zinc finger and BTB domain containing 11 | ZBTB11 | 15858 |
| zinc finger and BTB domain containing 12 | ZBTB12 | 15859 |
| zinc finger and BTB domain containing 14 | ZBTB14 | 15860 |
| zinc finger and BTB domain containing 16 | ZBTB16 | 15861 |
| zinc finger and BTB domain containing 17 | ZBTB17 | 15862 |
| zinc finger and BTB domain containing 18 | ZBTB18 | 15863 |
| zinc finger and BTB domain containing 2 | ZBTB2 | 15864 |
| zinc finger and BTB domain containing 20 | ZBTB20 | 15865 |
| zinc finger and BTB domain containing 21 | ZBTB21 | 15866 |
| zinc finger and BTB domain containing 22 | ZBTB22 | 15867 |
| zinc finger and BTB domain containing 24 | ZBTB24 | 15868 |
| zinc finger and BTB domain containing 25 | ZBTB25 | 15869 |
| zinc finger and BTB domain containing 26 | ZBTB26 | 15870 |
| zinc finger and BTB domain containing 3 | ZBTB3 | 15871 |
| zinc finger and BTB domain containing 32 | ZBTB32 | 15872 |
| zinc finger and BTB domain containing 33 | ZBTB33 | 15873 |
| zinc finger and BTB domain containing 34 | ZBTB34 | 15874 |
| zinc finger and BTB domain containing 37 | ZBTB37 | 15875 |

TABLE 4-continued

Exemplary Transcription Factors.

| Full Name | Abbreviation | SEQ ID NO: |
|---|---|---|
| zinc finger and BTB domain containing 38 | ZBTB38 | 15876 |
| zinc finger and BTB domain containing 39 | ZBTB39 | 15877 |
| zinc finger and BTB domain containing 4 | ZBTB4 | 15878 |
| zinc finger and BTB domain containing 40 | ZBTB40 | 15879 |
| zinc finger and BTB domain containing 41 | ZBTB41 | 15880 |
| zinc finger and BTB domain containing 42 | ZBTB42 | 15881 |
| zinc finger and BTB domain containing 43 | ZBTB43 | 15882 |
| zinc finger and BTB domain containing 44 | ZBTB44 | 15883 |
| zinc finger and BTB domain containing 45 | ZBTB45 | 15884 |
| zinc finger and BTB domain containing 46 | ZBTB46 | 15885 |
| zinc finger and BTB domain containing 47 | ZBTB47 | 15886 |
| zinc finger and BTB domain containing 48 | ZBTB48 | 15887 |
| zinc finger and BTB domain containing 49 | ZBTB49 | 15888 |
| zinc finger and BTB domain containing 5 | ZBTB5 | 15889 |
| zinc finger and BTB domain containing 6 | ZBTB6 | 15890 |
| zinc finger and BTB domain containing 7A | ZBTB7A | 15891 |
| zinc finger and BTB domain containing 7B | ZBTB7B | 15892 |
| zinc finger and BTB domain containing 7C | ZBTB7C | 15893 |
| zinc finger and BTB domain containing 8A | ZBTB8A | 15894 |
| zinc finger and BTB domain containing 9 | ZBTB9 | 15895 |
| zinc finger CCCH-type containing 10 | ZC3H10 | 15896 |
| zinc finger CCCH-type containing 11A | ZC3H11A | 15897 |
| zinc finger CCCH-type containing 12A | ZC3H12A | 15898 |
| zinc finger CCCH-type containing 12B | ZC3H12B | 15899 |
| zinc finger CCCH-type containing 13 | ZC3H13 | 15900 |
| zinc finger CCCH-type containing 14 | ZC3H14 | 15901 |
| zinc finger CCCH-type containing 15 | ZC3H15 | 15902 |
| zinc finger CCCH-type containing 18 | ZC3H18 | 15903 |
| zinc finger CCCH-type containing 3 | ZC3H3 | 15904 |
| zinc finger CCCH-type containing 4 | ZC3H4 | 15905 |
| zinc finger CCCH-type containing 6 | ZC3H6 | 15906 |
| zinc finger CCCH-type containing 7A | ZC3H7A | 15907 |
| zinc finger CCCH-type containing 7B | ZC3H7B | 15908 |
| zinc finger CCCH-type containing 8 | ZC3H8 | 15909 |
| zinc finger CCHC-type containing 11 | ZCCHC11 | 15910 |
| zinc finger CCHC-type containing 6 | ZCCHC6 | 15911 |
| zinc finger E-box binding homeobox 1 | ZEB1 | 15912 |
| zinc finger E-box binding homeobox 2 | ZEB2 | 15913 |
| zinc finger and AT-hook domain containing | ZFAT | 15914 |
| zinc finger homeobox 2 | ZFHX2 | 15915 |
| zinc finger homeobox 3 | ZFHX3 | 15916 |
| zinc finger homeobox 4 | ZFHX4 | 15917 |
| ZFP1 zinc finger protein | ZFP1 | 15918 |
| ZFP14 zinc finger protein | ZFP14 | 15919 |
| ZFP2 zinc finger protein | ZFP2 | 15920 |
| ZFP28 zinc finger protein | ZFP28 | 15921 |
| ZFP3 zinc finger protein | ZFP3 | 15922 |
| ZFP30 zinc finger protein | ZFP30 | 15923 |
| ZFP36 ring finger protein-like 1 | ZFP36L1 | 15924 |
| ZFP36 ring finger protein-like 2 | ZFP36L2 | 15925 |
| ZFP37 zinc finger protein | ZFP37 | 15926 |
| ZFP41 zinc finger protein | ZFP41 | 15927 |
| ZFP42 zinc finger protein | ZFP42 | 15928 |
| ZFP57 zinc finger protein | ZFP57 | 15929 |
| ZFP62 zinc finger protein | ZFP62 | 15930 |
| ZFP64 zinc finger protein | ZFP64 | 15931 |
| ZFP69 zinc finger protein | ZFP69 | 15932-15933 |
| ZFP69 zinc finger protein B | ZFP69B | 15934 |
| ZFP82 zinc finger protein | ZFP82 | 15935 |
| ZFP90 zinc finger protein | ZFP90 | 15936 |
| ZFP91 zinc finger protein | ZFP91 | 15937 |
| ZFP92 zinc finger protein | ZFP92 | 15938 |
| zinc finger protein, FOG family member 1 | ZFPM1 | 15939 |
| zinc finger protein, FOG family member 2 | ZFPM2 | 15940 |
| zinc finger protein, X-linked | ZFX | 15941 |
| zinc finger protein, Y-linked | ZFY | 15942 |
| zinc finger, FYVE domain containing 26 | ZFYVE26 | 15943 |
| zinc finger, GATA-like protein 1 | ZGLP1 | 15944 |
| zinc finger CCCH-type and G-patch domain containing | ZGPAT | 15945 |
| zinc fingers and homeoboxes 1 | ZHX1 | 15946 |
| zinc fingers and homeoboxes 2 | ZHX2 | 15947 |
| zinc fingers and homeoboxes 3 | ZHX3 | 15948 |
| Zic family member 1 | ZIC1 | 15949 |
| Zic family member 2 | ZIC2 | 15950 |
| Zic family member 3 | ZIC3 | 15951 |

TABLE 4-continued

Exemplary Transcription Factors.

| Full Name | Abbreviation | SEQ ID NO: |
|---|---|---|
| Zic family member 4 | ZIC4 | 15952 |
| Zic family member 5 | ZIC5 | 15953 |
| zinc finger protein interacting with K protein 1 | ZIK1 | 15954 |
| zinc finger, imprinted 2 | ZIM2 | 15955 |
| zinc finger, imprinted 3 | ZIM3 | 15956 |
| zinc finger with KRAB and SCAN domains 1 | ZKSCAN1 | 15957 |
| zinc finger with KRAB and SCAN domains 2 | ZKSCAN2 | 15958 |
| zinc finger with KRAB and SCAN domains 3 | ZKSCAN3 | 15959 |
| zinc finger with KRAB and SCAN domains 4 | ZKSCAN4 | 15960 |
| zinc finger with KRAB and SCAN domains 5 | ZKSCAN5 | 15961 |
| zinc finger with KRAB and SCAN domains 7 | ZKSCAN7 | 15962 |
| zinc finger with KRAB and SCAN domains 8 | ZKSCAN8 | 15963 |
| zinc finger matrin-type 1 | ZMAT1 | 15964 |
| zinc finger matrin-type 2 | ZMAT2 | 15965 |
| zinc finger matrin-type 3 | ZMAT3 | 15966 |
| zinc finger matrin-type 4 | ZMAT4 | 15967 |
| zinc finger matrin-type 5 | ZMAT5 | 15968 |
| zinc finger protein 10 | ZNF10 | 15969 |
| zinc finger protein 100 | ZNF100 | 15970 |
| zinc finger protein 101 | ZNF101 | 15971 |
| zinc finger protein 106 | ZNF106 | 15972 |
| zinc finger protein 107 | ZNF107 | 15973 |
| zinc finger protein 112 | ZNF112 | 15974 |
| zinc finger protein 114 | ZNF114 | 15975 |
| zinc finger protein 117 | ZNF117 | 15976 |
| zinc finger protein 12 | ZNF12 | 15977 |
| zinc finger protein 121 | ZNF121 | 15978 |
| zinc finger protein 124 | ZNF124 | 15979 |
| zinc finger protein 131 | ZNF131 | 15980 |
| zinc finger protein 132 | ZNF132 | 15981 |
| zinc finger protein 133 | ZNF133 | 15982 |
| zinc finger protein 134 | ZNF134 | 15983 |
| zinc finger protein 135 | ZNF135 | 15984 |
| zinc finger protein 136 | ZNF136 | 15985 |
| zinc finger protein 137, pseudogene | ZNF137P | 15986 |
| zinc finger protein 138 | ZNF138 | 15987 |
| zinc finger protein 14 | ZNF14 | 15988 |
| zinc finger protein 140 | ZNF140 | 15989 |
| zinc finger protein 141 | ZNF141 | 15990 |
| zinc finger protein 142 | ZNF142 | 15991 |
| zinc finger protein 143 | ZNF143 | 15992 |
| zinc finger protein 146 | ZNF146 | 15993 |
| zinc finger protein 148 | ZNF148 | 15994 |
| zinc finger protein 154 | ZNF154 | 15995 |
| zinc finger protein 155 | ZNF155 | 15996 |
| zinc finger protein 157 | ZNF157 | 15997 |
| zinc finger protein 16 | ZNF16 | 15998 |
| zinc finger protein 160 | ZNF160 | 15999 |
| zinc finger protein 165 | ZNF165 | 16000 |
| zinc finger protein 169 | ZNF169 | 16001 |
| zinc finger protein 17 | ZNF17 | 16002 |
| zinc finger protein 174 | ZNF174 | 16003 |
| zinc finger protein 175 | ZNF175 | 16004 |
| zinc finger protein 18 | ZNF18 | 16005 |
| zinc finger protein 180 | ZNF180 | 16006 |
| zinc finger protein 181 | ZNF181 | 16007 |
| zinc finger protein 182 | ZNF182 | 16008 |
| zinc finger protein 184 | ZNF184 | 16009 |
| zinc finger protein 189 | ZNF189 | 16010 |
| zinc finger protein 19 | ZNF19 | 16011 |
| zinc finger protein 195 | ZNF195 | 16012 |
| zinc finger protein 197 | ZNF197 | 16013 |
| zinc finger protein 2 | ZNF2 | 16014 |
| zinc finger protein 20 | ZNF20 | 16015-16016 |
| zinc finger protein 200 | ZNF200 | 16017 |
| zinc finger protein 202 | ZNF202 | 16018 |
| zinc finger protein 205 | ZNF205 | 16019 |
| zinc finger protein 207 | ZNF207 | 16020 |
| zinc finger protein 208 | ZNF208 | 16021 |
| zinc finger protein 211 | ZNF211 | 16022 |
| zinc finger protein 212 | ZNF212 | 16023 |
| zinc finger protein 213 | ZNF213 | 16024 |
| zinc finger protein 214 | ZNF214 | 16025 |
| zinc finger protein 215 | ZNF215 | 16026 |
| zinc finger protein 217 | ZNF217 | 16027 |
| zinc finger protein 219 | ZNF219 | 16028 |

TABLE 4-continued

Exemplary Transcription Factors.

| Full Name | Abbreviation | SEQ ID NO: |
|---|---|---|
| zinc finger protein 22 | ZNF22 | 16029 |
| zinc finger protein 221 | ZNF221 | 16030 |
| zinc finger protein 223 | ZNF223 | 16031 |
| zinc finger protein 224 | ZNF224 | 16032 |
| zinc finger protein 225 | ZNF225 | 16033-16034 |
| zinc finger protein 226 | ZNF226 | 16035 |
| zinc finger protein 227 | ZNF227 | 16036 |
| zinc finger protein 229 | ZNF229 | 16037 |
| zinc finger protein 23 | ZNF23 | 16038 |
| zinc finger protein 230 | ZNF230 | 16039-16040 |
| zinc finger protein 232 | ZNF232 | 16041 |
| zinc finger protein 233 | ZNF233 | 16042-16043 |
| zinc finger protein 234 | ZNF234 | 16044 |
| zinc finger protein 235 | ZNF235 | 16045 |
| zinc finger protein 236 | ZNF236 | 16046 |
| zinc finger protein 239 | ZNF239 | 16047 |
| zinc finger protein 24 | ZNF24 | 16048 |
| zinc finger protein 248 | ZNF248 | 16049 |
| zinc finger protein 25 | ZNF25 | 16050 |
| zinc finger protein 250 | ZNF250 | 16051 |
| zinc finger protein 251 | ZNF251 | 16052 |
| zinc finger protein 252, pseudogene | ZNF252P | 16053 |
| zinc finger protein 253 | ZNF253 | 16054 |
| zinc finger protein 254 | ZNF254 | 16055 |
| zinc finger protein 256 | ZNF256 | 16056 |
| zinc finger protein 257 | ZNF257 | 16057 |
| zinc finger protein 26 | ZNF26 | 16058 |
| zinc finger protein 260 | ZNF260 | 16059 |
| zinc finger protein 263 | ZNF263 | 16060 |
| zinc finger protein 264 | ZNF264 | 16061 |
| zinc finger protein 266 | ZNF266 | 16062 |
| zinc finger protein 267 | ZNF267 | 16063 |
| zinc finger protein 268 | ZNF268 | 16064 |
| zinc finger protein 273 | ZNF273 | 16065 |
| zinc finger protein 274 | ZNF274 | 16066 |
| zinc finger protein 275 | ZNF275 | 16067 |
| zinc finger protein 276 | ZNF276 | 16068 |
| zinc finger protein 277 | ZNF277 | 16069 |
| zinc finger protein 28 | ZNF28 | 16070 |
| zinc finger protein 280A | ZNF280A | 16071 |
| zinc finger protein 280B | ZNF280B | 16072 |
| zinc finger protein 280C | ZNF280C | 16073 |
| zinc finger protein 280D | ZNF280D | 16074 |
| zinc finger protein 281 | ZNF281 | 16075 |
| zinc finger protein 282 | ZNF282 | 16076 |
| zinc finger protein 283 | ZNF283 | 16077 |
| zinc finger protein 284 | ZNF284 | 16078 |
| zinc finger protein 285 | ZNF285 | 16079 |
| zinc finger protein 286A | ZNF286A | 16080 |
| zinc finger protein 286B | ZNF286B | 16081 |
| zinc finger protein 287 | ZNF287 | 16082 |
| zinc finger protein 292 | ZNF292 | 16083 |
| zinc finger protein 296 | ZNF296 | 16084 |
| zinc finger protein 3 | ZNF3 | 16085 |
| zinc finger protein 30 | ZNF30 | 16086 |
| zinc finger protein 300 | ZNF300 | 16087 |
| zinc finger protein 302 | ZNF302 | 16088 |
| zinc finger protein 304 | ZNF304 | 16089 |
| zinc finger protein 311 | ZNF311 | 16090 |
| zinc finger protein 316 | ZNF316 | 16091 |
| zinc finger protein 317 | ZNF317 | 16092 |
| zinc finger protein 318 | ZNF318 | 16093 |
| zinc finger protein 319 | ZNF319 | 16094 |
| zinc finger protein 32 | ZNF32 | 16095 |
| zinc finger protein 320 | ZNF320 | 16096 |
| zinc finger protein 322 | ZNF322 | 16097 |
| zinc finger protein 324 | ZNF324 | 16098 |
| zinc finger protein 324B | ZNF324B | 16099 |
| zinc finger protein 326 | ZNF326 | 16100 |
| zinc finger protein 329 | ZNF329 | 16101 |
| zinc finger protein 331 | ZNF331 | 16102 |
| zinc finger protein 333 | ZNF333 | 16103 |
| zinc finger protein 334 | ZNF334 | 16104 |
| zinc finger protein 335 | ZNF335 | 16105 |
| zinc finger protein 337 | ZNF337 | 16106 |
| zinc finger protein 33A | ZNF33A | 16107 |

TABLE 4-continued

Exemplary Transcription Factors.

| Full Name | Abbreviation | SEQ ID NO: |
|---|---|---|
| zinc finger protein 33B | ZNF33B | 16108 |
| zinc finger protein 34 | ZNF34 | 16109 |
| zinc finger protein 341 | ZNF341 | 16110 |
| zinc finger protein 343 | ZNF343 | 16111 |
| zinc finger protein 345 | ZNF345 | 16112 |
| zinc finger protein 346 | ZNF346 | 16113 |
| zinc finger protein 347 | ZNF347 | 16114 |
| zinc finger protein 35 | ZNF35 | 16115 |
| zinc finger protein 350 | ZNF350 | 16116 |
| zinc finger protein 354A | ZNF354A | 16117 |
| zinc finger protein 354B | ZNF354B | 16118 |
| zinc finger protein 354C | ZNF354C | 16119 |
| zinc finger protein 355, pseudogene | ZNF355P | 16120 |
| zinc finger protein 358 | ZNF358 | 16121 |
| zinc finger protein 362 | ZNF362 | 16122 |
| zinc finger protein 365 | ZNF365 | 16123-16124 |
| zinc finger protein 366 | ZNF366 | 16125 |
| zinc finger protein 367 | ZNF367 | 16126 |
| zinc finger protein 37A | ZNF37A | 16127 |
| zinc finger protein 382 | ZNF382 | 16128 |
| zinc finger protein 383 | ZNF383 | 16129 |
| zinc finger protein 384 | ZNF384 | 16130 |
| zinc finger protein 385A | ZNF385A | 16131 |
| zinc finger protein 385B | ZNF385B | 16132 |
| zinc finger protein 385C | ZNF385C | 16133 |
| zinc finger protein 385D | ZNF385D | 16134 |
| zinc finger protein 391 | ZNF391 | 16135 |
| zinc finger protein 394 | ZNF394 | 16136 |
| zinc finger protein 395 | ZNF395 | 16137 |
| zinc finger protein 396 | ZNF396 | 16138 |
| zinc finger protein 397 | ZNF397 | 16139 |
| zinc finger protein 398 | ZNF398 | 16140 |
| zinc finger protein 404 | ZNF404 | 16141 |
| zinc finger protein 407 | ZNF407 | 16142 |
| zinc finger protein 408 | ZNF408 | 16143 |
| zinc finger protein 41 | ZNF41 | 16144 |
| zinc finger protein 410 | ZNF410 | 16145 |
| zinc finger protein 414 | ZNF414 | 16146 |
| zinc finger protein 415 | ZNF415 | 16147 |
| zinc finger protein 416 | ZNF416 | 16148 |
| zinc finger protein 417 | ZNF417 | 16149 |
| zinc finger protein 418 | ZNF418 | 16150 |
| zinc finger protein 419 | ZNF419 | 16151 |
| zinc finger protein 420 | ZNF420 | 16152 |
| zinc finger protein 423 | ZNF423 | 16153 |
| zinc finger protein 425 | ZNF425 | 16154 |
| zinc finger protein 426 | ZNF426 | 16155 |
| zinc finger protein 428 | ZNF428 | 16156 |
| zinc finger protein 429 | ZNF429 | 16157 |
| zinc finger protein 43 | ZNF43 | 16158 |
| zinc finger protein 430 | ZNF430 | 16159 |
| zinc finger protein 431 | ZNF431 | 16160 |
| zinc finger protein 432 | ZNF432 | 16161 |
| zinc finger protein 433 | ZNF433 | 16162 |
| zinc finger protein 436 | ZNF436 | 16163 |
| zinc finger protein 438 | ZNF438 | 16164 |
| zinc finger protein 439 | ZNF439 | 16165 |
| zinc finger protein 44 | ZNF44 | 16166 |
| zinc finger protein 440 | ZNF440 | 16167 |
| zinc finger protein 441 | ZNF441 | 16168 |
| zinc finger protein 442 | ZNF442 | 16169 |
| zinc finger protein 443 | ZNF443 | 16170 |
| zinc finger protein 444 | ZNF444 | 16171 |
| zinc finger protein 445 | ZNF445 | 16172 |
| zinc finger protein 446 | ZNF446 | 16173 |
| zinc finger protein 449 | ZNF449 | 16174 |
| zinc finger protein 45 | ZNF45 | 16175 |
| zinc finger protein 451 | ZNF451 | 16176 |
| zinc finger protein 454 | ZNF454 | 16177 |
| zinc finger protein 460 | ZNF460 | 16178 |
| zinc finger protein 461 | ZNF461 | 16179 |
| zinc finger protein 462 | ZNF462 | 16180 |
| zinc finger protein 467 | ZNF467 | 16181 |
| zinc finger protein 468 | ZNF468 | 16182 |
| zinc finger protein 469 | ZNF469 | 16183 |
| zinc finger protein 470 | ZNF470 | 16184 |

TABLE 4-continued

Exemplary Transcription Factors.

| Full Name | Abbreviation | SEQ ID NO: |
|---|---|---|
| zinc finger protein 471 | ZNF471 | 16185 |
| zinc finger protein 473 | ZNF473 | 16186 |
| zinc finger protein 474 | ZNF474 | 16187-16188 |
| zinc finger protein 479 | ZNF479 | 16189 |
| zinc finger protein 48 | ZNF48 | 16190 |
| zinc finger protein 480 | ZNF480 | 16191 |
| zinc finger protein 483 | ZNF483 | 16192 |
| zinc finger protein 484 | ZNF484 | 16193 |
| zinc finger protein 485 | ZNF485 | 16194 |
| zinc finger protein 486 | ZNF486 | 16195 |
| zinc finger protein 487 | ZNF487 | 16196 |
| zinc finger protein 488 | ZNF488 | 16197 |
| zinc finger protein 490 | ZNF490 | 16198 |
| zinc finger protein 491 | ZNF491 | 16199 |
| zinc finger protein 492 | ZNF492 | 16200 |
| zinc finger protein 493 | ZNF493 | 16201 |
| zinc finger protein 496 | ZNF496 | 16202 |
| zinc finger protein 497 | ZNF497 | 16203 |
| zinc finger protein 500 | ZNF500 | 16204 |
| zinc finger protein 501 | ZNF501 | 16205 |
| zinc finger protein 502 | ZNF502 | 16206 |
| zinc finger protein 503 | ZNF503 | 16207 |
| zinc finger protein 506 | ZNF506 | 16208 |
| zinc finger protein 507 | ZNF507 | 16209 |
| zinc finger protein 510 | ZNF510 | 16210 |
| zinc finger protein 511 | ZNF511 | 16211 |
| zinc finger protein 512 | ZNF512 | 16212 |
| zinc finger protein 512B | ZNF512B | 16213 |
| zinc finger protein 513 | ZNF513 | 16214 |
| zinc finger protein 514 | ZNF514 | 16215 |
| zinc finger protein 516 | ZNF516 | 16216 |
| zinc finger protein 517 | ZNF517 | 16217 |
| zinc finger protein 518A | ZNF518A | 16218 |
| zinc finger protein 518B | ZNF518B | 16219 |
| zinc finger protein 519 | ZNF519 | 16220 |
| zinc finger protein 521 | ZNF521 | 16221 |
| zinc finger protein 524 | ZNF524 | 16222 |
| zinc finger protein 526 | ZNF526 | 16223 |
| zinc finger protein 527 | ZNF527 | 16224 |
| zinc finger protein 528 | ZNF528 | 16225 |
| zinc finger protein 529 | ZNF529 | 16226 |
| zinc finger protein 530 | ZNF530 | 16227 |
| zinc finger protein 532 | ZNF532 | 16228 |
| zinc finger protein 534 | ZNF534 | 16229 |
| zinc finger protein 536 | ZNF536 | 16230 |
| zinc finger protein 540 | ZNF540 | 16231 |
| zinc finger protein 541 | ZNF541 | 16232 |
| zinc finger protein 542, pseudogene | ZNF542P | 16233 |
| zinc finger protein 543 | ZNF543 | 16234 |
| zinc finger protein 544 | ZNF544 | 16235 |
| zinc finger protein 546 | ZNF546 | 16236 |
| zinc finger protein 547 | ZNF547 | 16237 |
| zinc finger protein 548 | ZNF548 | 16238 |
| zinc finger protein 549 | ZNF549 | 16239 |
| zinc finger protein 550 | ZNF550 | 16240 |
| zinc finger protein 552 | ZNF552 | 16241 |
| zinc finger protein 554 | ZNF554 | 16242 |
| zinc finger protein 555 | ZNF555 | 16243 |
| zinc finger protein 556 | ZNF556 | 16244 |
| zinc finger protein 557 | ZNF557 | 16245 |
| zinc finger protein 558 | ZNF558 | 16246 |
| zinc finger protein 559 | ZNF559 | 16247 |
| zinc finger protein 56 | ZNF56 | 16248 |
| zinc finger protein 560 | ZNF560 | 16249 |
| zinc finger protein 561 | ZNF561 | 16250 |
| zinc finger protein 562 | ZNF562 | 16251 |
| zinc finger protein 563 | ZNF563 | 16252 |
| zinc finger protein 564 | ZNF564 | 16253 |
| zinc finger protein 565 | ZNF565 | 16254 |
| zinc finger protein 566 | ZNF566 | 16255 |
| zinc finger protein 567 | ZNF567 | 16256 |
| zinc finger protein 568 | ZNF568 | 16257 |
| zinc finger protein 569 | ZNF569 | 16258 |
| zinc finger protein 57 | ZNF57 | 16259 |
| zinc finger protein 570 | ZNF570 | 16260 |
| zinc finger protein 571 | ZNF571 | 16261 |

TABLE 4-continued

Exemplary Transcription Factors.

| Full Name | Abbreviation | SEQ ID NO: |
|---|---|---|
| zinc finger protein 572 | ZNF572 | 16262 |
| zinc finger protein 573 | ZNF573 | 16263 |
| zinc finger protein 574 | ZNF574 | 16264 |
| zinc finger protein 575 | ZNF575 | 16265 |
| zinc finger protein 576 | ZNF576 | 16266-16267 |
| zinc finger protein 577 | ZNF577 | 16268 |
| zinc finger protein 578 | ZNF578 | 16269 |
| zinc finger protein 579 | ZNF579 | 16270 |
| zinc finger protein 580 | ZNF580 | 16271 |
| zinc finger protein 581 | ZNF581 | 16272 |
| zinc finger protein 582 | ZNF582 | 16273 |
| zinc finger protein 583 | ZNF583 | 16274 |
| zinc finger protein 584 | ZNF584 | 16275 |
| zinc finger protein 585A | ZNF585A | 16276 |
| zinc finger protein 585B | ZNF585B | 16277 |
| zinc finger protein 586 | ZNF586 | 16278 |
| zinc finger protein 587 | ZNF587 | 16279 |
| zinc finger protein 589 | ZNF589 | 16280 |
| zinc finger protein 592 | ZNF592 | 16281 |
| zinc finger protein 593 | ZNF593 | 16282 |
| zinc finger protein 594 | ZNF594 | 16283 |
| zinc finger protein 595 | ZNF595 | 16284 |
| zinc finger protein 596 | ZNF596 | 16285 |
| zinc finger protein 597 | ZNF597 | 16286 |
| zinc finger protein 598 | ZNF598 | 16287 |
| zinc finger protein 599 | ZNF599 | 16288 |
| zinc finger protein 600 | ZNF600 | 16289 |
| zinc finger protein 605 | ZNF605 | 16290 |
| zinc finger protein 606 | ZNF606 | 16291 |
| zinc finger protein 607 | ZNF607 | 16292 |
| zinc finger protein 608 | ZNF608 | 16293 |
| zinc finger protein 609 | ZNF609 | 16294 |
| zinc finger protein 610 | ZNF610 | 16295 |
| zinc finger protein 611 | ZNF611 | 16296 |
| zinc finger protein 613 | ZNF613 | 16297 |
| zinc finger protein 614 | ZNF614 | 16298 |
| zinc finger protein 615 | ZNF615 | 16299 |
| zinc finger protein 616 | ZNF616 | 16300 |
| zinc finger protein 618 | ZNF618 | 16301 |
| zinc finger protein 619 | ZNF619 | 16302 |
| zinc finger protein 620 | ZNF620 | 16303 |
| zinc finger protein 621 | ZNF621 | 16304 |
| zinc finger protein 622 | ZNF622 | 16305 |
| zinc finger protein 623 | ZNF623 | 16306 |
| zinc finger protein 624 | ZNF624 | 16307 |
| zinc finger protein 625 | ZNF625 | 16308 |
| zinc finger protein 626 | ZNF626 | 16309 |
| zinc finger protein 627 | ZNF627 | 16310 |
| zinc finger protein 628 | ZNF628 | 16311 |
| zinc finger protein 629 | ZNF629 | 16312 |
| zinc finger protein 639 | ZNF639 | 16313 |
| zinc finger protein 641 | ZNF641 | 16314 |
| zinc finger protein 644 | ZNF644 | 16315 |
| zinc finger protein 645 | ZNF645 | 16316 |
| zinc finger protein 646 | ZNF646 | 16317 |
| zinc finger protein 648 | ZNF648 | 16318 |
| zinc finger protein 649 | ZNF649 | 16319 |
| zinc finger protein 652 | ZNF652 | 16320 |
| zinc finger protein 653 | ZNF653 | 16321 |
| zinc finger protein 654 | ZNF654 | 16322 |
| zinc finger protein 655 | ZNF655 | 16323 |
| zinc finger protein 658 | ZNF658 | 16324 |
| zinc finger protein 658B (pseudogene) | ZNF658B | 16325 |
| zinc finger protein 66 | ZNF66 | 16326 |
| zinc finger protein 660 | ZNF660 | 16327 |
| zinc finger protein 662 | ZNF662 | 16328 |
| zinc finger protein 664 | ZNF664 | 16329 |
| zinc finger protein 665 | ZNF665 | 16330 |
| zinc finger protein 667 | ZNF667 | 16331 |
| zinc finger protein 668 | ZNF668 | 16332 |
| zinc finger protein 669 | ZNF669 | 16333 |
| zinc finger protein 670 | ZNF670 | 16334 |
| zinc finger protein 671 | ZNF671 | 16335 |
| zinc finger protein 672 | ZNF672 | 16336 |
| zinc finger protein 674 | ZNF674 | 16337 |
| zinc finger protein 675 | ZNF675 | 16338 |

TABLE 4-continued

Exemplary Transcription Factors.

| Full Name | Abbreviation | SEQ ID NO: |
|---|---|---|
| zinc finger protein 676 | ZNF676 | 16339 |
| zinc finger protein 677 | ZNF677 | 16340 |
| zinc finger protein 678 | ZNF678 | 16341 |
| zinc finger protein 679 | ZNF679 | 16342 |
| zinc finger protein 680 | ZNF680 | 16343 |
| zinc finger protein 681 | ZNF681 | 16344 |
| zinc finger protein 682 | ZNF682 | 16345 |
| zinc finger protein 683 | ZNF683 | 16346 |
| zinc finger protein 684 | ZNF684 | 16347 |
| zinc finger protein 687 | ZNF687 | 16348 |
| zinc finger protein 688 | ZNF688 | 16349 |
| zinc finger protein 689 | ZNF689 | 16350 |
| zinc finger protein 69 | ZNF69 | 16351 |
| zinc finger protein 691 | ZNF691 | 16352 |
| zinc finger protein 692 | ZNF692 | 16353 |
| zinc finger protein 695 | ZNF695 | 16354 |
| zinc finger protein 696 | ZNF696 | 16355 |
| zinc finger protein 697 | ZNF697 | 16356 |
| zinc finger protein 699 | ZNF699 | 16357 |
| zinc finger protein 7 | ZNF7 | 16358 |
| zinc finger protein 70 | ZNF70 | 16359 |
| zinc finger protein 701 | ZNF701 | 16360 |
| zinc finger protein 702, pseudogene | ZNF702P | 16361 |
| zinc finger protein 703 | ZNF703 | 16362 |
| zinc finger protein 704 | ZNF704 | 16363 |
| zinc finger protein 705A | ZNF705A | 16364 |
| zinc finger protein 705D | ZNF705D | 16365 |
| zinc finger protein 705E | ZNF705E | 16366 |
| zinc finger protein 705G | ZNF705G | 16367 |
| zinc finger protein 706 | ZNF706 | 16368 |
| zinc finger protein 707 | ZNF707 | 16369 |
| zinc finger protein 708 | ZNF708 | 16370 |
| zinc finger protein 709 | ZNF709 | 16371 |
| zinc finger protein 71 | ZNF71 | 16372 |
| zinc finger protein 710 | ZNF710 | 16373 |
| zinc finger protein 711 | ZNF711 | 16374 |
| zinc finger protein 713 | ZNF713 | 16375 |
| zinc finger protein 714 | ZNF714 | 16376 |
| zinc finger protein 716 | ZNF716 | 16377 |
| zinc finger protein 717 | ZNF717 | 16378 |
| zinc finger protein 718 | ZNF718 | 16379 |
| zinc finger protein 720 | ZNF720 | 16380 |
| zinc finger protein 721 | ZNF721 | 16381 |
| zinc finger protein 724, pseudogene | ZNF724P | 16382 |
| zinc finger protein 726 | ZNF726 | 16383 |
| zinc finger protein 727 | ZNF727 | 16384 |
| zinc finger protein 729 | ZNF729 | 16385 |
| zinc finger protein 730 | ZNF730 | 16386 |
| zinc finger protein 732 | ZNF732 | 16387 |
| zinc finger protein 735 | ZNF735 | 16388 |
| zinc finger protein 737 | ZNF737 | 16389 |
| zinc finger protein 74 | ZNF74 | 16390 |
| zinc finger protein 740 | ZNF740 | 16391 |
| zinc finger protein 746 | ZNF746 | 16392 |
| zinc finger protein 747 | ZNF747 | 16393 |
| zinc finger protein 749 | ZNF749 | 16394 |
| zinc finger protein 750 | ZNF750 | 16395 |
| zinc finger protein 75a | ZNF75A | 16396 |
| zinc finger protein 75D | ZNF75D | 16397 |
| zinc finger protein 76 | ZNF76 | 16398 |
| zinc finger protein 761 | ZNF761 | 16399 |
| zinc finger protein 763 | ZNF763 | 16400 |
| zinc finger protein 764 | ZNF764 | 16401 |
| zinc finger protein 765 | ZNF765 | 16402 |
| zinc finger protein 766 | ZNF766 | 16403 |
| zinc finger protein 768 | ZNF768 | 16404 |
| zinc finger protein 77 | ZNF77 | 16405 |
| zinc finger protein 770 | ZNF770 | 16406 |
| zinc finger protein 771 | ZNF771 | 16407 |
| zinc finger protein 772 | ZNF772 | 16408 |
| zinc finger protein 773 | ZNF773 | 16409 |
| zinc finger protein 774 | ZNF774 | 16410 |
| zinc finger protein 775 | ZNF775 | 16411 |
| zinc finger protein 776 | ZNF776 | 16412 |
| zinc finger protein 777 | ZNF777 | 16413 |
| zinc finger protein 778 | ZNF778 | 16414 |

TABLE 4-continued

Exemplary Transcription Factors.

| Full Name | Abbreviation | SEQ ID NO: |
|---|---|---|
| zinc finger protein 780A | ZNF780A | 16415 |
| zinc finger protein 780B | ZNF780B | 16416 |
| zinc finger protein 781 | ZNF781 | 16417 |
| zinc finger protein 782 | ZNF782 | 16418 |
| zinc finger family member 783 | ZNF783 | 16419 |
| zinc finger protein 784 | ZNF784 | 16420 |
| zinc finger protein 785 | ZNF785 | 16421 |
| zinc finger protein 786 | ZNF786 | 16422 |
| zinc finger protein 787 | ZNF787 | 16423 |
| zinc finger family member 788 | ZNF788 | 16424 |
| zinc finger protein 789 | ZNF789 | 16425 |
| zinc finger protein 79 | ZNF79 | 16426 |
| zinc finger protein 790 | ZNF790 | 16427 |
| zinc finger protein 791 | ZNF791 | 16428 |
| zinc finger protein 792 | ZNF792 | 16429 |
| zinc finger protein 793 | ZNF793 | 16430 |
| zinc finger protein 799 | ZNF799 | 16431 |
| zinc finger protein 8 | ZNF8 | 16432 |
| zinc finger protein 80 | ZNF80 | 16433 |
| zinc finger protein 800 | ZNF800 | 16434 |
| zinc finger protein 804A | ZNF804A | 16435 |
| zinc finger protein 804B | ZNF804B | 16436 |
| zinc finger protein 805 | ZNF805 | 16437 |
| zinc finger protein 806 | ZNF806 | 16438 |
| zinc finger protein 808 | ZNF808 | 16439 |
| zinc finger protein 81 | ZNF81 | 16440 |
| zinc finger protein 813 | ZNF813 | 16441 |
| zinc finger protein 814 | ZNF814 | 16442 |
| zinc finger protein 816 | ZNF816 | 16443 |
| zinc finger protein 821 | ZNF821 | 16444 |
| zinc finger protein 823 | ZNF823 | 16445 |
| zinc finger protein 827 | ZNF827 | 16446 |
| zinc finger protein 829 | ZNF829 | 16447 |
| zinc finger protein 83 | ZNF83 | 16448 |
| zinc finger protein 830 | ZNF830 | 16449 |
| zinc finger protein 831 | ZNF831 | 16450 |
| zinc finger protein 833, pseudogene | ZNF833P | 16451 |
| zinc finger protein 835 | ZNF835 | 16452 |
| zinc finger protein 836 | ZNF836 | 16453 |
| zinc finger protein 837 | ZNF837 | 16454 |
| zinc finger protein 839 | ZNF839 | 16455 |
| zinc finger protein 84 | ZNF84 | 16456 |
| zinc finger protein 840, pseudogene | ZNF840P | 16457 |
| zinc finger protein 841 | ZNF841 | 16458 |
| zinc finger protein 843 | ZNF843 | 16459 |
| zinc finger protein 844 | ZNF844 | 16460 |
| zinc finger protein 845 | ZNF845 | 16461 |
| zinc finger protein 846 | ZNF846 | 16462 |
| zinc finger protein 85 | ZNF85 | 16463 |
| zinc finger protein 853 | ZNF853 | 16464 |
| zinc finger protein 860 | ZNF860 | 16465 |
| zinc finger protein 876, pseudogene | ZNF876P | 16466 |
| zinc finger protein 878 | ZNF878 | 16467 |
| zinc finger protein 879 | ZNF879 | 16468 |
| zinc finger protein 880 | ZNF880 | 16469 |
| zinc finger protein 891 | ZNF891 | 16470 |
| zinc finger protein 90 | ZNF90 | 16471 |
| zinc finger protein 91 | ZNF91 | 16472 |
| zinc finger protein 92 | ZNF92 | 16473 |
| zinc finger protein 93 | ZNF93 | 16474 |
| zinc finger protein 98 | ZNF98 | 16475 |
| zinc finger protein 99 | ZNF99 | 16476 |
| zinc finger, NFX1-type containing 1 | ZNFX1 | 16477 |
| zinc finger and SCAN domain containing 1 | ZSCAN1 | 16478 |
| zinc finger and SCAN domain containing 10 | ZSCAN10 | 16479 |
| zinc finger and SCAN domain containing 12 | ZSCAN12 | 16480 |
| zinc finger and SCAN domain containing 16 | ZSCAN16 | 16481 |
| zinc finger and SCAN domain containing 18 | ZSCAN18 | 16482 |
| zinc finger and SCAN domain containing 2 | ZSCAN2 | 16483 |
| zinc finger and SCAN domain containing 20 | ZSCAN20 | 16484 |
| zinc finger and SCAN domain containing 21 | ZSCAN21 | 16485 |
| zinc finger and SCAN domain containing 22 | ZSCAN22 | 16486 |
| zinc finger and SCAN domain containing 23 | ZSCAN23 | 16487 |
| zinc finger and SCAN domain containing 25 | ZSCAN25 | 16488 |
| zinc finger and SCAN domain containing 26 | ZSCAN26 | 16489 |
| zinc finger and SCAN domain containing 29 | ZSCAN29 | 16490 |

TABLE 4-continued

Exemplary Transcription Factors.

| Full Name | Abbreviation | SEQ ID NO: |
|---|---|---|
| zinc finger and SCAN domain containing 30 | ZSCAN30 | 16491 |
| zinc finger and SCAN domain containing 31 | ZSCAN31 | 16492 |
| zinc finger and SCAN domain containing 32 | ZSCAN32 | 16493 |
| zinc finger and SCAN domain containing 4 | ZSCAN4 | 16494 |
| zinc finger and SCAN domain containing 5A | ZSCAN5A | 16495 |
| zinc finger and SCAN domain containing 5B | ZSCAN5B | 16496 |
| zinc finger and SCAN domain containing 5C, pseudogene | ZSCAN5CP | 16497 |
| zinc finger and SCAN domain containing 9 | ZSCAN9 | 16498 |
| zinc finger with UFM1-specific peptidase domain | ZUFSP | 16499 |
| zinc finger, X-linked, duplicated A | ZXDA | 16500 |
| zinc finger, X-linked, duplicated B | ZXDB | 16501 |
| ZXD family zinc finger C | ZXDC | 16502 |
| zinc finger ZZ-type containing 3 | ZZZ3 | 16503 |

In some embodiments, a T-cell of the disclosure is modified to silence or reduce expression of one or more gene(s) encoding a cell death or cell apoptosis receptor to produce an armored T-cell of the disclosure. Interaction of a death receptor and its endogenous ligand results in the initiation of apoptosis. Disruption of an expression, an activity, or an interaction of a cell death and/or cell apoptosis receptor and/or ligand render an armored T-cell of the disclosure less receptive to death signals, consequently, making the armored T cell of the disclosure more efficacious in a tumor environment. An exemplary cell death receptor which may be modified in an armored T cell of the disclosure is Fas (CD95). Exemplary cell death and/or cell apoptosis receptors and ligands of the disclosure include, but are not limited to, the exemplary receptors and ligands provided in Table 5.

TABLE 5

Exemplary Cell Death and/or Cell Apoptosis Receptors and Ligands.

| Full Name | Abbreviation | SEQ ID NO: |
|---|---|---|
| Cluster of Differentiation 120 | CD120a | 16504-16505 |
| Death receptor 3 | DR3 | 16506 |
| Death receptor 6 | DR6 | 16507 |
| first apoptosis signal (Fas) receptor | Fas (CD95/APO-1) | 16508-16509 |
| Fas Ligand | FasL | 16510 |
| cellular tumor antigen p53 | p53 | 16511 |
| Tumor necrosis factor receptor 1 | TNF-R1 | 16512 |
| Tumor necrosis factor receptor 2 | TNF-R2 | 16513 |
| Tumor necrosis factor-related apoptosis-inducing ligand receptor 1 | TRAIL-R1 (DR4) | 16514 |
| Tumor necrosis factor-related apoptosis-inducing ligand receptor 2 | TRAIL-R2 (DR5) | 16515 |
| Fas-associated protein with death domain | FADD | 16516 |
| Tumor necrosis factor receptor type 1-associated DEATH domain protein | TRADD | 16517 |
| Bcl-2-associated X protein | Bax | 16518 |
| Bcl-2 homologous killer | BAK | 16519 |
| 14-3-3 protein | 14-3-3 | 16520 |
| B-cell lymphoma 2 | Bcl-2 | 16521 |
| Cytochrome C | Cyt C | 16522 |
| Second mitochondria-derived activator of caspase | Smac/Diablo | 16523 |
| High temperature requirement protein A2 | HTRA2/Omi | 16524 |
| Apoptosis inducing factor | AIF | 16525 |
| Endonuclease G | EXOG | 16526 |
| Caspase 9 | Cas9 | 16527 |
| Caspase 2 | Cas2 | 16528 |
| Caspase 8 | Cas8 | 16529 |
| Caspase 10 | Cas10 | 16530 |
| Caspase 3 | Cas3 | 16531 |
| Caspase 6 | Cas6 | 16532 |
| Caspase 7 | Cas7 | 16533 |
| Tumor Necrosis Factor alpha | TNF-alpha | 16534 |
| TNF-related weak inducer of apoptosis | TWEAK | 16535 |
| TNF-related weak inducer of apoptosis receptor | TWEAK-R | 16536 |
| Tumor necrosis factor-related apoptosis-inducing ligand | TRAIL | 16537 |
| TNF ligand-related molecule 1 | TL1A | 16538 |
| Receptor-interacting serine/threonine-protein kinase 1 | RIP1 | 16539 |
| Cellular inhibitor of apoptosis 1 | cIAP-1 | 16540 |
| TNF receptor-associated factor 2 | TRAF-2 | 16541 |

In some embodiments, a T-cell of the disclosure is modified to silence or reduce expression of one or more gene(s) encoding a metabolic sensing protein to produce an armored T-cell of the disclosure. Disruption to the metabolic sensing of the immunosuppressive tumor microenvironment (characterized by low levels of oxygen pH glucose and other molecules) by an armored T-cell of the disclosure leads to extended retention of T-cell function and, consequently, more tumor cells killed per armored cell. For example, HIF1a and VHL play a role in T-cell function while in a hypoxic environment. An armored T-cell of the disclosure may have silenced or reduced expression of one or more genes encoding HIF1a or VHL. Genes and proteins involved in metabolic sensing include, but are not limited to the exemplary genes and proteins provided in Table 6.

TABLE 6

Exemplary Metabolic Sensing Genes (and encoded Proteins).

| Full Name | Metabolite | Abbreviation | SEQ ID NO: |
|---|---|---|---|
| hypoxia-inducible factor 1α | Low oxygen | HIF-1α | 16542 |
| von Hippel–Lindau tumor suppressor | Low oxygen | VHL | 16543 |
| Prolyl-hydroxylase domain proteins | High oxygen | PHD proteins | |
| Glucose transporter 1 | glucose | GLUT1 | 16544 |
| Linker of Activated T cells | Amino acid (leucine) | LAT | 16545 |
| CD98 glycoprotein | Amino acid (leucine) | CD98 | 16546 |
| Alanine, serine, cysteine-preferring transporter 2 | Cationic Amino acid (glutamine) | ASCT2/Slc1a5 | 16547 |
| Solute carrier family 7 member 1 | Cationic Amino acids | Slc7a1 | 16548 |
| Solute carrier family 7 member 2 | Cationic Amino acids | Slc7a2 | 16549 |
| Solute carrier family 7 member 3 | Cationic Amino acids | Slc7a3 | 16550 |
| Solute carrier family 7 member 4 | Cationic Amino acids | Slc7a4 | 16551 |
| Solute carrier family 7 member 5 | Glycoprotein associated Amino acids | Slc7a5 | 16552 |
| Solute carrier family 7 member 6 | Glycoprotein associated Amino acids | Slc7a6 | 16553 |
| Solute carrier family 7 member 7 | Glycoprotein associated Amino acids | Slc7a7 | 16554 |
| Solute carrier family 7 member 8 | Glycoprotein associated Amino acids | Slc7a8 | 16555 |
| Solute carrier family 7 member 9 | Glycoprotein associated Amino acids | Slc7a9 | 16556 |
| Solute carrier family 7 member 10 | Glycoprotein associated Amino acids | Slc7a10 | 16557 |
| Solute carrier family 7 member 11 | Glycoprotein associated Amino acids | Slc7a11 | 16558 |
| Solute carrier family 7 member 13 | Glycoprotein associated Amino acids | Slc7a13 | 16559 |
| Solute carrier family 7 member 14 | Cationic Amino acids | Slc7a14 | 16560 |
| Solute carrier family 3 member 2 | Amino acid | Slc3a2 | 16561 |
| Calcium transport protein 2 | Cationic Amino acid (arginine) | CAT2 | 16562 |
| Calcium transport protein 3 | Cationic Amino acid (arginine) | CAT3 | 16563 |
| Calcium transport protein 4 | Cationic Amino acid (arginine) | CAT4 | 16564 |
| Bromodomain adjacent to zinc finger domain protein 1B | Amino acid (arginine) | BAZ1B | 16565 |
| PC4 and SFRS1-interacting protein | Amino acid (arginine) | PSIP1 | 16566 |
| Translin | Amino acid (arginine) | TSN | 16567 |
| G-protein-coupled receptors | Fatty Acid and Cholesterol | GPCRs | |
| T-cell Receptor, subunit alpha | Fatty Acid and Cholesterol | TCR alpha | 16568 |
| T-cell Receptor, subunit beta | Fatty Acid and Cholesterol | TCR beta | 16569 |
| T-cell Receptor, subunit zeta | Fatty Acid and Cholesterol | TCR zeta | 16570 |
| T-cell Receptor, subunit CD3 epsilon | Fatty Acid and Cholesterol | TCR CD3 epsilon | 16571 |
| T-cell Receptor, subunit CD3 gamma | Fatty Acid and Cholesterol | TCR CD3 gamma | 16572 |
| T-cell Receptor, subunit CD3 delta | Fatty Acid and Cholesterol | TCR CD3 delta | 16573 |
| peroxisome proliferator-activated receptors | Fatty Acid and Cholesterol | PPARs | |
| AMP-activated protein kinase | Energy homeostasis (intracellular AMP to ATP ratio) | AMPK | 16574-16575 |
| P2X purinoceptor 7 | Redox homeostasis | P2X7 | 16576 |

In some embodiments a T-cell of the disclosure is modified to silence or reduce therapy, including a monoclonal antibody, to produce an armored T-cell of the disclosure. Thus an armored T-cell of the disclosure can function and may demonstrate superior function or efficacy whilst in the presence of a cancer therapy (e.g. a chemotherapy, a monoclonal antibody therapy, or another anti-tumor treatment). Proteins involved in conferring sensitivity to a cancer therapy include, but are not limited to, the exemplary proteins provided in Table 7.

TABLE 7

Exemplary Proteins that Confer Sensitivity to a Cancer Therapeutic.

| Full Name | Abbreviation | SEQ ID NO: |
|---|---|---|
| Copper-transporting ATPase 2 | ATP7B | 16577 |
| Breakpoint cluster region protein | BCR | 16578 |
| Abelson tyrosine-protein kinase 1 | ABL | 16579 |
| Breast cancer resistance protein | BCRP | 16580 |
| Breast cancer type 1 susceptibility protein | BRCA1 | 16581 |
| Breast cancer type 2 susceptibility protein | BRCA2 | 16582 |
| CAMPATH-1 antigen | CD52 | 16583 |
| Cytochrome P450 2D6 | CYP2D6 | 16584 |
| Deoxycytidine kinase | dCK | 16585 |
| Dihydrofolate reductase | DHFR | 16586 |
| Dihydropyrimidine dehydrogenase [NADP (+)] | DPYD | 16587 |
| Epidermal growth factor receptor | EGFR | 16588 |
| DNA excision repair protein ERCC-1 | ERCC1 | 16589 |
| Estrogen Receptor | ESR | 16590 |
| Low affinity immunoglobulin gamma Fc region receptor III-A | FCGR3A | 16591 |
| Receptor tyrosine-protein kinase erbB-2 | HER2 or ERBB2 | 16592 |
| Insulin-like growth factor 1 receptor | IGF1R | 16593 |
| GTPase KRas | KRAS | 16594 |
| Multidrug resistance protein 1 | MDR1 or ABCB1 | 16595 |
| Methylated-DNA--protein-cysteine methyltransferase | MGMT | 16596 |
| Multidrug resistance-associated protein 1 | MRP1 or ABCC1 | 16597 |
| Progesterone Receptor | PGR | 16598 |
| Regulator of G-protein signaling 10 | RGS10 | 16599 |
| Suppressor of cytokine signaling 3 | SOCS-3 | 16600 |
| Thymidylate synthase | TYMS | 16601 |
| UDP-glucuronosyltransferase 1-1 | UGT1A1 | 16602 |

In some embodiments, a T-cell of the disclosure is modified to silence or reduce expression of one or more gene(s) encoding a growth advantage factor to produce an armored T-cell. Silencing or reducing expression of an oncogene can confer a growth advantage for an armored T-cell of the disclosure. For example, silencing or reducing expression (e.g. disrupting expression) of a TET2 gene during a CAR-T manufacturing process results in the generation of an armored CAR-T with a significant capacity for expansion and subsequent eradication of a tumor when compared to anon-armored CAR-T lacking this capacity for expansion. This strategy may be coupled to a safety switch (e.g. an iC9 safety switch of the disclosure), which allows for the targeted disruption of an armored CAR-T-cell in the event of an adverse reaction from a subject or uncontrolled growth of the armored CAR-T. Exemplary growth advantage factors include, but are not limited to, the factors provided in Table 8.

TABLE 8

Exemplary Growth Advantage Factors.

| Full Name | Abbreviation | SEQ ID NO: |
|---|---|---|
| Ten Eleven Translocation 2 | TET2 | 16603 |
| DNA (cytosine-5)-methyltransferase 3A | DNMT3A | 16604 |
| Transforming protein RhoA | RHOA | 16605 |
| Proto-oncogene vav | VAV1 | 16606 |
| Rhombotin-2 | LMO2 | 16607 |
| T-cell acute lymphocytic leukemia protein 1 | TAL1 | 16608 |
| Suppressor of cytokine signaling 1 | SOCS1 | 16609 |
| herpes virus entry mediator | HVEM | 16610 |
| T cell death-associated gene 8 | TDAG8 | 16611 |
| BCL6 corepressor | BCOR | 16612 |
| B and T cell attenuator | BTLA | 16613 |
| SPARC-like protein 1 | SPARCL1 | 16614 |
| Msh homeobox 1-like protein | MSX1 | 16615 |

Armored T-Cells "Null or Switch Receptor" Strategy

In some embodiments, a T-cell of the disclosure is modified to express a modified/chimeric checkpoint receptor to produce an armored T-cell of the disclosure.

In some embodiments, the modified/chimeric checkpoint receptor comprises a null receptor, decoy receptor or dominant negative receptor. A null receptor, decoy receptor or dominant negative receptor of the disclosure may be modified/chimeric receptor/protein. A null receptor, decoy receptor or dominant negative receptor of the disclosure may be truncated for expression of the intracellular signaling domain. Alternatively, or in addition, a null receptor, decoy receptor or dominant negative receptor of the disclosure may be mutated within an intracellular signaling domain at one or more amino acid positions that are determinative or required for effective signaling. Truncation or mutation of null receptor, decoy receptor or dominant negative receptor of the disclosure may result in loss of the receptor's capacity to convey or transduce a checkpoint signal to the cell or within the cell.

For example, a dilution or a blockage of an immunosuppressive checkpoint signal from a PD-L1 receptor expressed on the surface of a tumor cell may be achieved by expressing a modified/chimeric PD-1 null receptor on the surface of an armored T-cell of the disclosure, which effectively competes with the endogenous (non-modified) PD-1 receptors also expressed on the surface of the armored T-cell to reduce or inhibit the transduction of the immunosuppressive checkpoint signal through endogenous PD-1 receptors of the armored T cell. In this exemplary embodiment, competition between the two different receptors for binding to PD-L1 expressed on the tumor cell reduces or diminishes a level of effective checkpoint signaling, thereby enhancing a therapeutic potential of the armored T-cell expressing the PD-1 null receptor.

In some embodiments, the modified/chimeric checkpoint receptor comprises a null receptor, decoy receptor or dominant negative receptor that is a transmembrane receptor.

In some embodiments, the modified/chimeric checkpoint receptor comprises a null receptor, decoy receptor or dominant negative receptor that is a membrane-associated or membrane-linked receptor/protein.

In some embodiments, the modified/chimeric checkpoint receptor comprises a null receptor, decoy receptor or dominant negative receptor that is an intracellular receptor/protein.

In some embodiments, the modified/chimeric checkpoint receptor comprises a null receptor, decoy receptor or dominant negative receptor that is an intracellular receptor/protein. Exemplary null, decoy, or dominant negative intracellular receptors/proteins of the disclosure include, but are not limited to, signaling components downstream of an inhibitory checkpoint signal (as provided, for example, in Tables 2 and 3), a transcription factor (as provided, for example, in Table 4), a cytokine or a cytokine receptor, a chemokine or a chemokine receptor, a cell death or apoptosis receptor/ligand (as provided, for example, in Table 5), a metabolic sensing molecule (as provided, for example, in Table 6), a protein conferring sensitivity to a cancer therapy (as provided, for example, in Table 7), and an oncogene or a tumor suppressor gene (as provided, for example, in Table 8). Exemplary cytokines, cytokine receptors, chemokines and chemokine receptors of the disclosure include, but are not limited to, the cytokines and cytokine receptors as well as chemokines and chemokine receptors provided in Table 9.

TABLE 9

Exemplary Cytokines, Cytokine receptors, Chemokines and Chemokine Receptors.

| Full Name | Abbreviation | SEQ ID NO: |
| --- | --- | --- |
| 4-1BB Ligand | 4-1BBL | 16616 |
| Tumor necrosis factor receptor superfamily member 25 | Apo3 or TNFRSF25 | 16617 |
| Tumor necrosis factor receptor superfamily member 13 | APRIL or TNFRSF13 | 16618 |
| Bcl2-associated agonist of cell death | Bcl-xL or BAD | 16619 |
| Tumor necrosis factor receptor superfamily member 17 | BCMA or TNFRS17 | 16620 |
| C-C motif chemokine 1 | CCL1 | 16621 |
| C-C motif chemokine 11 | CCL11 | 16622 |
| C-C motif chemokine 13 | CCL13 | 16623 |
| C-C motif chemokine 14 | CCL14 | 16624 |
| C-C motif chemokine 15 | CCL15 | 16625 |
| C-C motif chemokine 16 | CCL16 | 16626 |
| C-C motif chemokine 17 | CCL17 | 16627 |
| C-C motif chemokine 18 | CCL18 | 16628 |
| C-C motif chemokine 19 | CCL19 | 16629 |
| C-C motif chemokine 2 | CCL2 | 16630 |
| C-C motif chemokine 20 | CCL20 | 16631 |
| C-C motif chemokine 21 | CCL21 | 16632 |
| C-C motif chemokine 22 | CCL22 | 16633 |
| C-C motif chemokine 23 | CCL23 | 16634 |
| C-C motif chemokine 24 | CCL24 | 16635 |
| C-C motif chemokine 25 | CCL25 | 16636 |
| C-C motif chemokine 26 | CCL26 | 16637 |
| C-C motif chemokine 27 | CCL27 | 16638 |
| C-C motif chemokine 28 | CCL28 | 16639 |
| C-C motif chemokine 3 | CCL3 | 16640 |
| C-C motif chemokine 4 | CCL4 | 16641 |
| C-C motif chemokine 5 | CCL5 | 16642 |
| C-C motif chemokine 7 | CCL7 | 16643 |
| C-C motif chemokine 8 | CCL8 | 16644 |
| C-C chemokine receptor type 1 | CCR1 | 16645 |
| C-C chemokine receptor type 10 | CCR10 | 16646 |
| C-C chemokine receptor type 11 | CCR11 | 16647 |
| C-C chemokine receptor type 2 | CCR2 | 16648 |
| C-C chemokine receptor type 3 | CCR3 | 16649 |
| C-C chemokine receptor type 4 | CCR4 | 16650 |
| C-C chemokine receptor type 5 | CCR5 | 16651 |
| C-C chemokine receptor type 6 | CCR6 | 16652 |
| C-C chemokine receptor type 7 | CCR7 | 16653 |
| C-C chemokine receptor type 8 | CCR8 | 16654 |
| C-C chemokine receptor type 9 | CCR9 | 16655 |

TABLE 9-continued

Exemplary Cytokines, Cytokine receptors, Chemokines and Chemokine Receptors.

| Full Name | Abbreviation | SEQ ID NO: |
|---|---|---|
| Granulocyte colony-stimulating factor receptor | CD114 or CSF3R | 16656 |
| Macrophage colony-stimulating factor 1 receptor | CD115 or CSF1R | 16657 |
| Granulocyte-macrophage colony-stimulating factor receptor subunit alpha | CD116 or CSF2RA | 16658 |
| Mast/stem cell growth factor receptor Kit | CD117 or KIT | 16659 |
| Leukemia inhibitory factor receptor | CD118 or LIFR | 16660 |
| Tumor necrosis factor receptor superfamily member 1A | CD120a or TNFRSF1A | 16661 |
| Tumor necrosis factor receptor superfamily member 1B | CD120b or TNFRSF1B | 16662 |
| Interleukin-1 receptor type 1 | CD121a or IL1R1 | 16663 |
| Interleukin-2 receptor subunit beta | CD122 or IL2RB | 16664 |
| Interleukin-3 receptor subunit alpha | CD123 or IL3RA | 16665 |
| Interleukin-4 receptor subunit alpha | CD124 or IL4R | 16666 |
| Interleukin-6 receptor subunit alpha | CD126 or IL6R | 16667 |
| Interleukin-7 receptor subunit alpha | CD127 or IL7R | 16668 |
| Interleukin-6 receptor subunit beta | CD130 or IL6ST | 16669 |
| Cytokine receptor common subunit gamma | CD132 or IL2RG | 16670 |
| Tumor necrosis factor ligand superfamily member 8 | CD153 or TNFSF8 | 16671 |
| CD40 ligand | CD154 or CD4OL | 16672 |
| Tumor necrosis factor ligand superfamily member 6 | CD178 or FASLG | 16673 |
| Interleukin-12 receptor subunit beta-1 | CD212 or IL12RB1 | 16674 |
| Interleukin-13 receptor subunit alpha-1 | CD213a1 or IL13RA1 | 16675 |
| Interleukin-13 receptor subunit alpha-2 | CD213a2 or IL13RA2 | 16676 |
| Interleukin-2 receptor subunit alpha | CD25 or IL2RA | 16677 |
| CD27 antigen | CD27 | 16678 |
| Tumor necrosis factor receptor superfamily member 8 | CD30 or TNTRSF | 16679 |
| T-cell surface glycoprotein CD4 | CD4 | 16680 |
| Tumor necrosis factor receptor superfamily member 5 | CD40 or TNFRSF5 | 16681 |
| CD70 antigen | CD70 | 16682 |
| Tumor necrosis factor receptor superfamily member 6 | CD95 or FAS or FNFRSF6 | 16683 |
| Granulocyte-macrophage colony-stimulating factor receptor subunit alpha | CDw116 or CSF2RA | 16684 |
| Interferon gamma receptor 1 | CDw119 or IFNGR1 | 16685 |
| Interleukin-1 receptor type 2 | CDw12lb or IL1R2 | 16686 |
| Interleukin-5 receptor subunit alpha | CDw125 or IL5RA | 16687 |
| Cytokine receptor common subunit beta | CDw131 or CSF2RB | 16688 |
| Tumor necrosis factor receptor superfamily member 9 | CDw137 or TNFRSF9 | 16689 |
| Interleukin-10 receptor | CDw210 or IL1OR | 16690 |
| Interleukin-17 receptor A | CDw217 or IL17RA | 16691 |
| C-X3-C motif chemokine 1 | CX3CL1 | 16692 |
| C-X3-C chemokine receptor 1 | CX3CR1 | 16693 |
| C-X-C motif chemokine 1 | CXCL1 | 16694 |
| C-X-C motif chemokine 10 | CXCL10 | 16695 |
| C-X-C motif chemokine 11 | CXCL11 | 16696 |
| C-X-C motif chemokine 12 | CXCL12 | 16697 |
| C-X-C motif chemokine 13 | CXCL13 | 16698 |
| C-X-C motif chemokine 14 | CXCL14 | 16699 |
| C-X-C motif chemokine 16 | CXCL16 | 16700 |
| C-X-C motif chemokine 2 | CXCL2 | 16701 |
| C-X-C motif chemokine 3 | CXCL3 | 16702 |
| C-X-C motif chemokine 4 | CXCL4 | 16703 |
| C-X-C motif chemokine 5 | CXCL5 | 16704 |
| C-X-C motif chemokine 6 | CXCL6 | 16705 |
| C-X-C motif chemokine 7 | CXCL7 | 16706 |
| C-X-C motif chemokine 8 | CXCL8 | 16707 |
| C-X-C motif chemokine 9 | CXCL9 | 16708 |
| C-X-C chemokine receptor type 1 | CXCR1 | 16709 |
| C-X-C chemokine receptor type 2 | CXCR2 | 16710 |
| C-X-C chemokine receptor type 3 | C.XCR3 | 16711 |
| C-X-C chemokine receptor type 4 | CXCR4 | 16712 |
| C-X-C chemokine receptor type 5 | CXCR5 | 16713 |
| C-X-C chemokine receptor type 6 | CXCR6 | 16714 |
| C-X-C chemokine receptor type 7 | CXCR7 | 16715 |
| Atypical chemokine receptor 1 | DARC or ACKR1 | 16716 |

TABLE 9-continued

Exemplary Cytokines, Cytokine receptors, Chemokines and Chemokine Receptors.

| Full Name | Abbreviation | SEQ ID NO: |
|---|---|---|
| Erythropoietin | Epo | 16717 |
| Erythropoietin receptor | EpoR | 16718 |
| Receptor-type tyrosine-protein kinase FLT3 | Flt-3 | 16719 |
| FLT3 Ligand | Flt-3L | 16720 |
| Granulocyte colony-stimulating factor receptor | G-CSF or GSF3R | 16721 |
| Tumor necrosis factor receptor superfamily member 18 | GITR or TNERSFI8 | 16722 |
| GITR Ligand | GITRL | 16723 |
| Cytokine receptor common subunit beta | GM-CSF or CSF2RB | 16724 |
| Interleukin-6 receptor subunit beta | gp130 or IL6ST | 16725 |
| Tumor necrosis factor receptor superfamily member 14 | HVEM or TNFRSF14 | 16726 |
| Interferon gamma | IFNγ | 16727 |
| Interferon gamma receptor 2 | IFNGR2 | 16728 |
| Interferon-alpha | IFN-α | 16729 |
| Interferon-beta | IFN-β | 16730 |
| Interleukin-1 alpha | IL1 | 16731 |
| Interleukin-10 | IL10 | 16732 |
| Interleukin-10 receptor | IL10R | 16733 |
| Interleukin-11 | IL-11 | 16734 |
| Interleukin-11 receptor alpha | IL-11Ra | 16735 |
| Interleukin-12 | IL12 | 16736 |
| Interleukin-13 | IL13 | 16737 |
| Interleukin-13 receptor | IL13R | 16738 |
| Interleukin-14 | IL-14 | 16739 |
| Interleukin-15 | IL15 | 16740 |
| Interleukin-15 receptor alpha | IL-15Ra | 16741 |
| Interleukin-16 | IL-16 | 16742 |
| Interleukin-17 | IL17 | 16743 |
| Interleukin-17 receptor | IL17R | 16744 |
| Interleukin-18 | IL18 | 16745 |
| InterIeukin-1 receptor alpha | IL-1RA | 16746 |
| Interleukin-1 alpha | IL-1α | 16747 |
| Interleukin-l beta | IL-1β | 16748 |
| interleukin-2 | IL2 | 16749 |
| interleukin-20 | IL-20 | 16750 |
| Interleukin-20 receptor alpha | IL-20Rα | 16751 |
| Interleukin-20 receptor beta | IL-20Rβ | 16752 |
| Interleukin-21 | IL21 | 16753 |
| Interleukin-3 | IL-3 | 16754 |
| interleukin-35 | IL35 | 16755 |
| Interleukin-4 | IL4 | 16756 |
| Interleukin-4 receptor | IL4R | 16757 |
| Interleukin-5 | IL5 | 16758 |
| Interleukin-5 receptor | IL5R | 16759 |
| Interleukin-6 | IL6 | 16760 |
| Interleukin-6 receptor | IL6R | 16761 |
| Interleukin-7 | IL7 | 16762 |
| Interleukin-9 receptor | IL-9R | 16763 |
| Leukemia inhibitory factor | LIF | 16764 |
| Leukemia inhibitory factor receptor | LIFR | 16765 |
| tumor necrosis factor superfamay member 14 | LIGHT or TNFSF14 | 16766 |
| Tumor necrosis factor receptor superfamily member 3 | LTβR or INFRSF3 | 16767 |
| Lymphotoxin-beta | LT-β | 16768 |
| Macrophage colony-stimulating factor 1 | M-CSF | 16769 |
| Tumor necrosis factor receptor superfamily member 11B | OPG or TNFRSF11B | 16770 |
| Oncostatin-M | OSM | 16771 |
| Oncostatin-M receptor | OSMR | 16772 |
| Tumor necrosis factor receptor superfamily member 4 | OX40 or TNFRSF4 | 16773 |
| Tumor necrosis factor ligand superfamily member 4 | OX40L or TNFSF4 | 16774 |
| Tumor necrosis factor receptor superfamily member 11A | RANK or TNFRSF11A | 16775 |
| Kit Ligana | SCF or KITLG | 16776 |
| Tumor necrosis factor receptor superfamay member 13B | TACI or TNFRSF13B | 16777 |
| Tumor necrosis factor ligand superfamily member -13B | TALL-I or TNFSF13B | 16778 |
| TGF-beta receptor type-1 | TGF-βR1 | 16779 |

TABLE 9-continued

Exemplary Cytokines, Cytokine receptors, Chemokines and Chemokine Receptors.

| Full Name | Abbreviation | SEQ ID NO: |
|---|---|---|
| TGF-beta receptor type-2 | TGF-βR2 | 16780 |
| TGF-beta receptor type-3 | TGF-βR3 | 16781 |
| Transforming growth factor beta-1 | TGF-β1 | 16782 |
| Transforming growth factor beta-2 | TGF-β2 | 16783 |
| Transforming growth factor beta-3 | TGF-β3 | 16784 |
| Tumor necrosis factor alpha | TNF or TNF-α | 16785 |
| Tumor necrosis factor beta | TNF-β | 16786 |
| Thyroid peroxidase | Tpo | 16787 |
| Thyroid peroxidase receptor | TpoR | 16788 |
| Tumor necrosis factor ligand superfamay member 10 | TRAIL or TNFSF10 | 16789 |
| Tumor necrosis factor receptor superfamay member 10A | TRAILR1 or TNFRSF10A | 16790 |
| Tumor necrosis factor receptor superfamily member 10B | TRAILR2 or TNFRSF10B | 16791 |
| Tumor necrosis factor ligand superfamily member 11 | TRANCE or TNFSF11 | 16792 |
| Tumor necrosis factor ligand superfamay member 12 | TWEAK or TNFSF11 | 16793 |
| Lymphotactin | XCL1 | 16794 |
| Cytokine SCM-1 beta | XCL2 | 16795 |

In some embodiments, the modified/chimeric checkpoint receptor comprises a switch receptor. Exemplary switch receptors may comprise a modified chimeric receptor/protein of the disclosure wherein a native or wild type intracellular signaling domain is switched or replaced with a different intracellular signaling domain that is either non-native to the protein and/or not a wild-type domain. For example, replacement of an inhibitory signaling domain with a stimulatory signaling domain would switch an immunosuppressive signal into an immunostimulatory signal. Alternatively, replacement of an inhibitory signaling domain with a different inhibitory domain can reduce or enhance the level of inhibitory signaling. Expression or overexpression, of a switch receptor can result in the dilution and/or blockage of a cognate checkpoint signal via competition with an endogenous wildtype checkpoint receptor (not a switch receptor) for binding to the cognate checkpoint receptor expressed within the immunosuppressive tumor microenvironment. Armored T cells of the disclosure may comprise a sequence encoding switch receptors of the disclosure, leading to the expression of one or more switch receptors of the disclosure, and consequently, altering an activity of an armored T-cell of the disclosure. Armored T cells of the disclosure may express a switch receptor of the disclosure that targets an intracellularly expressed protein downstream of a checkpoint receptor, a transcription factor, a cytokine receptor, a death receptor, a metabolic sensing molecule, a cancer therapy, an oncogene, and/or a tumor suppressor protein or gene of the disclosure.

Exemplary switch receptors of the disclosure may comprise or may be derived from a protein including, but are not limited to, the signaling components downstream of an inhibitory checkpoint signal (as provided, for example, in Tables 2 and 3), a transcription factor (as provided, for example, in Table 4), a cytokine or a cytokine receptor, a chemokine or a chemokine receptor, a cell death or apoptosis receptor/ligand (as provided, for example, in Table 5), a metabolic sensing molecule (as provided, for example, in Table 6), a protein conferring sensitivity to a cancer therapy (as provided, for example, in Table 7), and an oncogene or a tumor suppressor gene (as provided, for example, in Table 8). Exemplary cytokines, cytokine receptors, chemokines and chemokine receptors of the disclosure include, but are not limited to, the cytokines and cytokine receptors as well as chemokines and chemokine receptors provided in Table 9.

Armored T-Cells "Synthetic Gene Expression" Strategy

In some embodiments, a T-cell of the disclosure is modified to express chimeric ligand receptor (CLR) or a chimeric antigen receptor (CAR) that mediates conditional gene expression to produce an armored T-cell of the disclosure. The combination of the CLR/CAR and the condition gene expression system in the nucleus of the armored T cell constitutes a synthetic gene expression system that is conditionally activated upon binding of cognate ligand(s) with CLR or cognate antigen(s) with CAR. This system may help to 'armor' or enhance therapeutic potential of modified T cells by reducing or limiting synthetic gene expression at the site of ligand or antigen binding, at or within the tumor environment for example.

Exogenous Receptors

In some embodiments, the armored T-cell comprises a composition comprising (a) an inducible transgene construct, comprising a sequence encoding an inducible promoter and a sequence encoding a transgene, and (b) a receptor construct, comprising a sequence encoding a constitutive promoter and a sequence encoding an exogenous receptor, such as a CLR or CAR, wherein, upon integration of the construct of (a) and the construct of (b) into a genomic sequence of a cell, the exogenous receptor is expressed, and wherein the exogenous receptor, upon binding a ligand or antigen, transduces an intracellular signal that targets directly or indirectly the inducible promoter regulating expression of the inducible transgene (a) to modify gene expression.

In some embodiments of a synthetic gene expression system of the disclosure, the composition modifies gene expression by decreasing gene expression. In some embodiments, the composition modifies gene expression by transiently modifying gene expression (e.g. for the duration of binding of the ligand to the exogenous receptor). In some embodiments, the composition modifies gene expression acutely (e.g. the ligand reversibly binds to the exogenous receptor). In some embodiments, the composition modifies gene expression chronically (e.g. the ligand irreversibly binds to the exogenous receptor).

In some embodiments of the compositions of the disclosure, the exogenous receptor of (b) comprises an endogenous receptor with respect to the genomic sequence of the cell. Exemplary receptors include, but are not limited to, intracellular receptors, cell-surface receptors, transmembrane receptors, ligand-gated ion channels, and G-protein coupled receptors.

In some embodiments of the compositions of the disclosure, the exogenous receptor of (b) comprises a non-naturally occurring receptor. In some embodiments, the non-naturally occurring receptor is a synthetic, modified, recombinant, mutant or chimeric receptor. In some embodiments, the non-naturally occurring receptor comprises one or more sequences isolated or derived from a T-cell receptor (TCR). In some embodiments, the non-naturally occurring receptor comprises one or more sequences isolated or derived from a scaffold protein. In some embodiments, including those wherein the non-naturally occurring receptor does not comprise a transmembrane domain, the non-naturally occurring receptor interacts with a second transmembrane, membrane-bound and/or an intracellular receptor that, following contact with the non-naturally occurring receptor, transduces an intracellular signal.

In some embodiments of the compositions of the disclosure, the exogenous receptor of (b) comprises a non-naturally occurring receptor. In some embodiments, the non-naturally occurring receptor is a synthetic, modified, recombinant, mutant or chimeric receptor. In some embodiments, the non-naturally occurring receptor comprises one or more sequences isolated or derived from a T-cell receptor (TCR). In some embodiments, the non-naturally occurring receptor comprises one or more sequences isolated or derived from a scaffold protein. In some embodiments, the non-naturally occurring receptor comprises a transmembrane domain. In some embodiments, the non-naturally occurring receptor interacts with an intracellular receptor that transduces an intracellular signal. In some embodiments, the non-naturally occurring receptor comprises an intracellular signalling domain. In some embodiments, the non-naturally occurring receptor is a chimeric ligand receptor (CLR). In some embodiments, the CLR is a chimeric antigen receptor (CAR).

In some embodiments of the compositions of the disclosure, the exogenous receptor of (b) comprises a non-naturally occurring receptor. In some embodiments, the CLR is a chimeric antigen receptor (CAR). In some embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In some embodiments, the ectodomain of (a) further comprises a signal peptide. In some embodiments, the ectodomain of (a) further comprises a hinge between the ligand recognition region and the transmembrane domain.

In some embodiments of the CLR/CARs of the disclosure, the signal peptide comprises a sequence encoding a human CD2, CD3δ, CD3ε, CD3, CD3ζ, CD4, CD8α, CD19, CD28, 4-1 BB or GM-CSFR signal peptide. In some embodiments, the signal peptide comprises a sequence encoding a human CD8α signal peptide. In some embodiments, the signal peptide comprises an amino acid sequence comprising MALPVTALLLPLALLLHAARP (SEQ ID NO: 17000). In some embodiments, the signal peptide is encoded by a nucleic acid sequence comprising atggcactgccagtcaccgccctgctgctgcctctggctctgctgctgcacgcagctagacca (SEQ ID NO: 17001).

In some embodiments of the CLR/CARs of the disclosure, the transmembrane domain comprises a sequence encoding a human CD2, CD3δ, CD3ε, CD3γ, CD3ζ, CD4, CD8α, CD19, CD28, 4-1BB or GM-CSFR transmembrane domain. In some embodiments, the transmembrane domain comprises a sequence encoding a human CD8α transmembrane domain. In some embodiments, the transmembrane domain comprises an amino acid sequence comprising IYIWAPLAGTCGVLLLSLVITLYC (SEQ ID NO: 17002). In some embodiments, the transmembrane domain is encoded by a nucleic acid sequence comprising (SEQ ID NO: 17003)
atctacatttgggcaccactggccgggacctgtggag tgctgctgctgagcctggtcatcacactgtactgc.

In some embodiments of the CLR/CARs of the disclosure, the endodomain comprises a human CD3ζ endodomain. In some embodiments, the at least one costimulatory domain comprises a human 4-1BB, CD28, CD3ζ, CD40, ICOS, MyD88, OX-40 intracellular segment, or an) combination thereof. In some embodiments, the at least one costimulatory domain comprises a human CD3ζ and/or a 4-1 BB costimulatory domain. In some embodiments, the CD3ζ costimulatory domain comprises an amino acid sequence comprising RVKFSRSADAPAYKQGQNQLYNELNLGRREEYDVLDKRRGRDPEMGGKPRRKNPQ EGLYNELQKDKMAEAYSEIGMKGERRRGKGHDGLYQGLSTATKDTYDALHMQALP PR (SEQ ID NO: 17004). In some embodiments, the CD3ζ costimulatory domain is encoded by a nucleic acid sequence comprising (SEQ ID NO: 17005)
cgcgtgaagtttagtcgatcagcagatgccccagcttacaaaca gggacagaaccagctgtataacgagctgaatctgggccgccgag aggaatatgacgtgctggataagcggagaggacgcgaccccgaa atgggaggcaagcccaggcgcaaaaaccctcaggaaggcctgta taacgagctgcagaaggacaaaatggcagaagcctattctgaga tcggcatgaaggggggagcgacggagaggcaaagggcacgatggg ctgtaccagggactgagcaccgccacaaaggacacctatgatgc tctgcatatgcaggcactgcctccaagg.

In some embodiments, the 4-1BB costimulatory domain comprises an amino acid sequence comprising KRGRKKLLYIFKQPFMRPVQTTQEEDGCSCRFPEEEEGGCEL (SEQ ID NO: 17006). In some embodiments, the 4-1BB costimulatory domain is encoded by a nucleic acid sequence comprising aagagaggcaggaagaaactgctgtatattttcaaacagcccttcatgcgccccgtgcagactacccaggaggaagacgggtgctcc tgtcgatccctgaggaagaggaaggcgggtgtgagctg (SEQ ID NO: 17007). In some embodiments, the 4-1BB costimulatory domain is located between the transmembrane domain and the CD3ζ costimulatory domain.

In some embodiments of the CLR/CARs of the disclosure, the hinge comprises a sequence derived from a human CD8α, IgG4, and/or CD4 sequence. In some embodiments, the hinge comprises a sequence derived from a human CD8α sequence. In some embodiments, the hinge comprises an amino acid sequence comprising

TTTPAPRPPTPAPTIASQPLSLR (SEQ NO: 17008)

PEACRPAAGGAVHTRGLDFACD,

In some embodiments, the hinge is encoded by a nucleic acid sequence comprising actaccacaccagcacctagaccac-caactccagctccaaccatcgcgagtcagcccctgagtctgagacct-gaggcctgcaggcc agctgcaggaggag-etgtgcacaccaggggctggacttcgcctgegac (SEQ ID NO: 17028). In some embodiments, the hinge is encoded by a nucleic acid sequence comprising ACCACAACCCCTGCCCCCA-GACCTCCCACACCCGCCCCTAC-CATCGCGAGTCAGCCCCTGAGTCTGA GACCT-GAGGCCTGCAGGCCAGCTGCAGGAGGAGCTGT-GCACACCAGGGGCCTGGACTTCGCCTGC GAC (SEQ ID NO: 17009). In some embodiments, the at least one protein scaffold specifically binds the ligand.

In some embodiments of the compositions of the disclosure, the exogenous receptor of (b) comprises a non-naturally occurring receptor. In some embodiments, the CLR is a chimeric antigen receptor (CAR). In some embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In some embodiments, the at least one protein scaffold comprises an antibody, an antibody fragment, a single domain antibody, a single chain antibody, an antibody mimetic, or a Centyrin (referred to herein as a CARTyrin). In some embodiments, the ligand recognition region comprises one or more of an antibody, an antibody fragment, a single domain antibody, a single chain antibody, an antibody mimetic, and a Centyrin. In some embodiments, the single domain antibody comprises or consists of a VHH or a VH (referred to herein as a VCAR). In some embodiments, the single domain antibody comprises or consists of a VHH or a VH comprising human complementarity determining regions (CDRs). In some embodiments, the VH is a recombinant or chimeric protein. In some embodiments, the VH is a recombinant or chimeric human protein. In some embodiments, the antibody mimetic comprises or consists of an affibody, an afflilin, an affimer, an affitin, an alphabody, an anticalin, an avimer, a DARPin, a Fynomer, a Kunitz domain peptide or a monobody. In some embodiments, the Centyrin comprises or consists of a consensus sequence of at least one fibronectin type III (FN3) domain.

In some embodiments of the compositions of the disclosure, the exogenous receptor of (b) comprises a non-naturally occurring receptor. In some embodiments, the CLR is a chimeric antigen receptor (CAR) In some embodiments, the chimeric ligand receptor comprises (a) an ectodomain comprising a ligand recognition region, wherein the ligand recognition region comprises at least scaffold protein; (b) a transmembrane domain, and (c) an endodomain comprising at least one costimulatory domain. In some embodiments, the Centyrin comprises or consists of a consensus sequence of at least one fibronectin type III (FN3) domain. In some embodiments, the at least one fibronectin type III (FN3) domain is derived from a human protein. In some embodiments, the human protein is Tenascin-C. In some embodiments, the consensus sequence comprises LPAPKNLVV-SEVTEDSLRLSWTAPDAAFDSFLIQYQESEKVGE-AINLTVPGSERSYDL TGLKPGTEYTVSIYGVKGGHRSNPLSAEFTT (SEQ ID NO: 17010). In some embodiments, the consensus sequence comprises MLPAPKNLVVSEVTEDSLRLSWTAPDAAF-DSFLIQYQESEKVGEAINLTVPGSERSYD LTGLKPGTEYTVSIYGVKGGHRSNPLSAEFTT (SEQ ID NO: 17011). In some embodiments, the consensus sequence is modified at one or more positions within (a) a A-B loop comprising or consisting of the amino acid residues TEDS at positions 13-16 of the consensus sequence; (b) a B-C loop comprising or consisting of the amino acid residues TAPDAAF at positions 22-28 of the consensus sequence; (c) a C-D loop comprising or consisting of the amino acid residues SEKVGE at positions 38-43 of the consensus sequence; (d) a D-E loop comprising or consisting of the amino acid residues GSER at positions 51-54 of the consensus sequence; (e) a E-F loop comprising or consisting of the amino acid residues GLKPG at positions 60-64 of the consensus sequence; (f) a F-G loop comprising or consisting of the amino acid residues KGGHRSN at positions 75-81 of the consensus sequence; or (g) any combination of (a)-(f). In some embodiments, the Centyrin comprises a consensus sequence of at least 5 fibronectin type III (FN3) domains. In some embodiments, the Centyrin comprises a consensus sequence of at least 10 fibronectin type III (FN3) domains. In some embodiments, the Centyrin comprises a consensus sequence of at least 15 fibronectin type III (FN3) domains. In some embodiments, the scaffold binds an antigen with at least one affinity selected from a $K_D$ of less than or equal to $10^{-9}$ M, less than or equal to $10^{-10}$ M, less than or equal to $10^{-11}$ M, less than or equal to $10^{-12}$ M, less than or equal to $10^{-13}$ M, less than or equal to $10^{-14}$ M, and less than or equal to $10^{-15}$ M. In some embodiments, the $K_D$ is determined by surface plasmon resonance.

Inducible Promoters

In certain embodiments of the compositions of the disclosure, the sequence encoding the inducible promoter of (a) comprises a sequence encoding an NFκB promoter. In certain embodiments of the compositions of the disclosure, the sequence encoding the inducible promoter of (a) comprises a sequence encoding an interferon (IFN) promoter or a sequence encoding an interleukin-2 promoter. In certain embodiments of the compositions of the disclosure, the sequence encoding the inducible promoter of (a) comprises a sequence encoding a nuclear receptor subfamily 4 group A member 1 (NR4A1; also known as NUR77) promoter or a sequence encoding a NR4A1 promoter. In certain embodiments of the compositions of the disclosure, the sequence encoding the inducible promoter of (a) comprises a sequence encoding a T-cell surface glycoprotein CD5 (CD5) promoter or a sequence encoding a CD5 promoter. In certain embodiments, the interferon (IFN) promoter is an IFNγ promoter. In certain embodiments of the compositions of the disclosure, the inducible promoter is isolated or derived from the promoter of a cytokine or a chemokine. In certain embodiments, the cytokine or chemokine comprises IL2, IL3, IL4, IL5, IL6, IL10, IL12, IL13, IL17A/F, IL21, IL22, IL23, transforming growth factor beta (TGFβ), colony stimulating factor 2 (GM-CSF), interferon gamma (IFNγ), Tumor necrosis factor (TNFα), LTα, perforin, Granzyme C (Gzmc), Granzyme B (Gzmb), C-C motif chemokine ligand 5 (CCL5), C-C motif chemokine ligand 4 (CCL4), C-C motif chemokine ligand 3 (CCL3), X-C motif chemokine ligand 1 (XCL1) and LIF interleukin 6 family cytokine (Lif).

In certain embodiments of the compositions of the disclosure, including those wherein the sequence encoding the inducible promoter of (a) comprises a sequence encoding a NR4A1 promoter or a sequence encoding a NR4A1 promoter, the NR4A1 promoter is activated by T-cell Receptor (TCR) stimulation in T cells and by B-cell Receptor (BCR) stimulation in B cells, therefore, inducing expression of any sequence under control of the NR4A1 promoter upon activation of a T-cell or B-cell of the disclosure through a TCR or BCR, respectively.

In certain embodiments of the compositions of the disclosure, including those wherein the sequence encoding the inducible promoter of (a) comprises a sequence encoding a CD5 promoter or a sequence encoding a CD5 promoter, the CD5 promoter is activated by T-cell Receptor (TCR) stimulation in T cells, therefore, inducing expression of any sequence under control of the CD5 promoter upon activation of a T-cell of the disclosure through a TCR.

In certain embodiments of the compositions of the disclosure, the inducible promoter is isolated or derived from the promoter of a gene comprising a surface protein involved in cell differention, activation, exhaustion and function. In certain embodiments, the gene comprises CD69, CD71, CTLA4, PD-1, TIGIT, LAG3, TIM-3, GITR, MHCII, COX-2, FASL and 4-1BB.

In some embodiments of the compositions of the disclosure, the inducible promoter is isolated or derived from the promoter of a gene involved in CD metabolism and differentiation. In some embodiments of the compositions of the disclosure, the inducible promoter is isolated or derived from the promoter of Nr4a1, Nr4a3, Tnfrsf9 (4-1BB), Sema7a, Zfp3612, Gadd45b. Dusp5, Dusp6 and Neto2.

Inducible Transgene

In some embodiments, the inducible transgene construct comprises or drives expression of a signaling component downstream of an inhibitory checkpoint signal (as provided, for example, in Tables 2 and 3), a transcription factor (as provided, for example, in Table 4), a cytokine or a cytokine receptor, a chemokine or a chemokine receptor, a cell death or apoptosis receptor/ligand (as provided, for example, in Table 5), a metabolic sensing molecule (as provided, for example, in Table 6), a protein conferring sensitivity to a cancer therapy (as provided, for example, in Table 7 and/or 1), and an oncogene or a tumor suppressor gene (as provided, for example, in Table 8). Exemplary cytokines, cytokine receptors, chemokines and chemokine receptors of the disclosure include, but are not limited to, the cytokines and cytokine receptors as well as chemokines and chemokine receptors provided in Table 9.

Cas-Clover

The disclosure provides a composition comprising a guide RNA and a fusion protein or a sequence encoding the fusion protein wherein the fusion protein comprises a dCas9 and a Clo051 endonuclease or a nuclease domain thereof.

Small Cas9 (SaCas9)

The disclosure provides compositions comprising a small, Cas9 (Cas9) operatively-linked to an effector. In certain embodiments, the disclosure provides a fusion protein comprising, consisting essentially of or consisting of a DNA localization component and an effector molecule, wherein the effector comprises a small, Cas9 (Cas9). In certain embodiments, a small Cas9 construct of the disclosure may comprise an effector comprising a type IIS endonuclease.

Amino acid sequence of *Staphylococcus aureus* Cas9 with an active catalytic site.

```
                                       (SEQ ID NO: 17074)
   1 mkrnyilgld igitsvgygi idyetrdvid agvrlfkean vennegrrsk rgarrlkrrr
```

```
                         -continued
  61 rhriqrvkkl lfdynlltdh selsginpye arvkglsqkl seeefsaall hlakrrgvhn 121 vneveedtgn elstkeqisr nskaleekyv aelqlerlkk dgevrgsinr fktsdyvkea 181 kgllkvqkay hqldqsfidt yidlletrrt yyegpgegsp fgwkdikewy emlmghctyf 241 peelrsvkya ynadlynaln dlnnlvitrd enekleyyek fqiienvfkq kkkptlkqia 301 keilvneedi kgvrvtstgk peftnlkvyh dikditarke iienaelldq iakiltivqs 361 sedigeeltn inseltqeei egisnikgyt gthnlslkai nlildelwht ndnqiaifnr 421 lklvpkkvdl sqqkeipttl vddfilspvv krsfiqsikv inaiikkygl pndiiielar 461 eknskdaqkm inemqkrnrq tnerieeiir ttgkenakyl iekiklhdmq egkclyslea 541 ipledllnnp fnyevdhiip rsvsfdnsfn nkvlvkqeen skkgnrtpfq ylsssdskis 601 yetfkkhiln lakgkgrisk tkkeylleer dinrfsvqkd finrnlvdtr yatrglmnll 661 rsyfrvnnld vkvksinggf tsflrrkwkf kkernkgykh haedaliian adfifkewkk 721 ldkakkvmen qmfeekqaes mpeieteqey keifitphqi khikdfkdyk yshrvdkkpn 781 relindtlys trkddkgntl ivnnlnglyd kdndklkkli nkspekllmv hhdpqtyqkl 841 klimeqygde knplykyyee tgnyltkysk kdngpvikki kyygnklnah lditddypns 901 rnkvvklslk pyrfdvyldn gvykfvtvkn ldvikkenyy evnskcyeea kklkkisnqa 961 efiasfynnd likingelyr vigvnndlln rievnmidit yreyienmnd krppriikti 1021 asktqsikky stdilgnlve vkskkhpqii kkg
```

Inactivated, Small Cas9 (dSaCas9)

The disclosure provides compositions comprising an inactivated, small, Cas9 (dSaCas9) operatively-linked to an effector. In certain embodiments, the disclosure provides a fusion protein comprising, consisting essentially of or consisting of a DNA localization component and an effector molecule, wherein the effector comprises a small, inactivated Cas9 (dSaCas9). In certain embodiments, a small, inactivated Cas9 (dSaCas9) construct of the disclosure may comprise an effector comprising a type IIS endonuclease.

dSaCas9 Sequence: D10A and N580A mutations (bold, capitalized, and underlined) inactivate the catalytic site.

(SEQ ID NO: 17075)

```
  1 mkrnviiglA igitsvgygi idyetrdvid
    agvrlfkean vennegrrsk rgarrlkrrr
 61 rhrigrvkkl lfdvnlltdh selsginpye
    arvkglsqkl seeefsaall hlakrrgvhn
121 vneveedtgn elstkeqisr nskaleekyv
    aelqlerlkk dgevrgsinr fktsdyvkea
181 kgllkvqkay hqldqsfidt yidlletrrt
    yyegpgegsp fgwkdikewy emlmghctyf
241 peelrsvkya ynadlynaln dlnnlvitrd
    enekleyyek fqiienvfkg kkkptlkqia
301 keilvneedi kgyrvtstqk peftnlkvyh
    dikditarke iienaelldq iakiltiyqs
361 sediqeeltn lnseltqeei eqisnlkgyt
    gthnlslkai nlildelwht ndnqiaifnr
421 lklvpkkvdl sqqkeipttl vddfilspvv
    krsfiqsikv inaiikkygi pndiiielar
481 eknskdaqkm inemqkrnrq tnerieeiir
    ttgkenakyl iekiklhdmq egkclyslea
541 ipledllnnp fnyevdhiip rsvsfdnsfn
    nkvlvkqeeA skkgnrtpfq ylsssdskis
601 yetfkkhiln lakgkgrisk tkkeylleer
    dinrfsvqkd finrnlvdtr yatrglmnll
```

```
 661 rsyfrvnnld vkvksinggf tsflrrkwkf
     kkernkgykh haedaliian adfifkewkk
 721 ldkakkvmen qmfeekqaes mpeieteqey
     keifitphqi khikdfkdyk yshrvdkkpn
 781 relindtlys trkddkgntl ivnnlnglyd
     kdndklkkli nkspekllmy hhdpqtyqkl
 841 klimeqygde knplykyyee tgnyltkysk
     kdngpvikki kyygnklnah lditddypns
 901 rnkvvklslk pyrfdvyldn gvykfvtvkn
     ldvikkenyy evnskcyeea kklkkisnqa
 961 efiasfynnd likingelyr vigvnndlln
     rievnmidit yreylenmnd krppriikti
1021 asktgsikky stdilgnlye vkskkhpqii
     kkg
```

Inactivated Cas9 (dCas9)

The disclosure provides compositions comprising an inactivated Cas9 (dCas9) operatively-linked to an effector. In certain embodiments, the disclosure provides a fusion protein comprising, consisting essentially of or consisting of a DNA localization component and an effector molecule, wherein the effector comprises an inactivated Cas9 (dCas9). In certain embodiments, an inactivated Cas9 (dCas9) construct of the disclosure may comprise an effector comprising a type IIS endonuclease.

In certain embodiments, the dCas9 of the disclosure comprises a dCas9 isolated or derived from *Staphylococcus pyogenes*. In certain embodiments, the dCas9 comprises a dCas9 with substitutions at positions 10 and 840 of the amino acid sequence of the dCas9 which inactivate the catalytic site. In certain embodiments, these substitutions are D10A and H840A. In certain embodiments, the amino acid sequence of the dCas9 comprises the sequence of:

(SEQ ID NO: 17076)

```
  1 XDKKYSIGLA IGTNSVGWAV ITDEYKVPSK KFKVLGNTDR HSIKKNLIGA LLFDSGETAE
 61 ATRLKRTARR RYTRRKNRIC YLQEIFSNEM AKVDDSFFHR LEESFLVEED KKHERHPIFG
121 NIVDEVAYHE KYPTTYHLRK KLVDSTDKAD LRLIYLALAH MIKFRGHFLI EGDLNPDNSD
181 VDKLFIQLVQ TYNQLFEENP INASGVDAKA ILSARLSKSR RLENLIAQLP GEKKNGLFGN
241 LIALSLGLTP NFKSNFDLAE DAKLQLSKDT YDDDLDNLLA QIGDQYADLF LAAKNLSDAI
301 LLSDILRVNT EITKAPLSAS MIKRYDEHHQ DLTLLKALVR QQLPEKYKEI FFDQSKHGYA
361 GYIDGGASQE EFYKFIKPIL EKMDGTEELL VKLNREDLLR KQRTFDNGSI PHQIHLGELH
421 AILRRQEDFY PFLKDNREKI EKILTFRIPY YVGPLARGKS RFAWMTRKSE ETITPWNFEE
481 VVDKGASAQS FIERMTNFDK NLPNEKVLPK HSLLYEYFTV YNELTKVKYV TEGMRKPAFL
541 SGEQKKAIVD LLFKTNRKVT VKQLKEDYFK KIECFDSVEI SGVEDRFNAS LGTYHDLLKI
601 IKDKDFLDNE ENEDILEDIV LTLTLFEDRE MIEERLKTYA HLFDDKVMKQ LKRRRYTGWG
661 RLSRKLINGI RDKQSGKTIL DFLKSDGFAN RNFMQLIHDD SLTFKEDIQK AQVSGQGDSL
721 HEHIAMLAGS PAIKKGILQT VKVVDELVKV MGRHKPENIV IEMARENQTT QKGQKNSRER
781 MKRIEEGIKE LGSQILKEHP VENTQLQNEK LYLYYLQNGR DMYVDQELDI NRLSDYDVDA
841 IVPQSFLKDD SIDNKVLTRS DKNRGKSDNV PSEEVVKKMK NYWRQLLNAK LITQRKFDNL
```

```
 901 TKAERGGLSE LDKAGFIKRQ LVETRQITKH VAQILDSRMN TKYDENDKLI REVKVITLKS

961 KLVSDFRKDF QFYKVREINN YHHAHDAYLN AVVGTALIKK YPKLESEFVY GDYKVYDVRK

1021 MIAKSEQEIG KATAKYFFYS NIMNFFKTEI TLANGEIRKR PLIETNGETG EIVWDKGRDF

1081 ATVRKVLSMP QVNIVKKTEV QTGGFSKESI LPKRNSDKLI ARKKDWDPKK YGGFDSPTVA

1141 YSVLVVAKVE KGKSKKLKSV KELLGITIME RSSFEKNPID FLEAKGYKEV KKDLIIKLPK

1201 YSLFELENGR KRMLASAGEL QKGNELALPS KYVNFLYLAS HYEKLKGSPE DNEQKQLFVE

1261 QHKHYLDEII EQISEFSKRV ILADANLDKV LSAYNKHRDK PIREQAENII HLFTLTNLGA

1321 PAAFKYFDTT IDRKRYTSTK EVLDATLIHQ SITGLYETRI DLSQLGGD.
```

In certain embodiments, the amino acid sequence of the dCas9 comprises the sequence of:

```
                                                     (SEQ ID NO: 17077)
   1 MBKKYSIGLA IGTNSVGWAV ITDEYKVPSK KFKVLGNTDR HSIKKNLIGA LLFDSGETAE

61 ATRLRRTARR RYTRRKNRIC YLQEIFSNEM AKVDDSFFKR LEESFLVEED KKHERHPIFG

121 NIVDEVAYHE KYPTIYHLRK KLVDSTDKAD LRLIYLALAH MIKFRGHFLI EGDLNPDNSD

181 VDKLFIQLVQ TYNQLFEENP INASGVDAKA ILSARLSKSR RLENLIAQLP GEKKNGLFGN

241 LIALSLGLTP NFKSNFDLAE DAKLQLSKDT YDDDLDNLLA QIGDQYADLF LAAKNLSDAI

301 LLSDILRVNT EITKAPLSAS MIKRYDEHHQ DLTLLKALVR QQLPEKYKEI FFDQSKNGYA

361 GYIDGGASQE EFYKFIKPIL EKMDGTEELL VKLNREDLLR KQRTFDNGSI PHQIHLGELH

421 AILRRQEDFY PFLKDNREKI EKILTFRIPY YVGPLARGNS RFAWMTRKSE ETITPWNFEE

481 VVDKGASAQS FIERMTMFDK NLPNEKVLPK HSLLYEYFTV YNELTKVKYV TEGMRKPAFL

541 SGEQKKAIVD LLFKTNRKVT VKQLKEDYFK KIECFDSVEI SGVEDRFNAS LGTYHDLLKI

601 IKDKDFLDNE ENEDILEDIV LTLTLFEDRE MIEERLKTYA HLFDDKVMKQ LKRRRYTGWG

661 RLSRKLINGI RDKQSGKTIL DFLKSDGFAN RNFMQLIHDD SLTFKEDIQK AQVSGQGDSL

721 HEHIANLAGS PAIKKGILQT VKVVDELVKV MGRHKPENIV IEMARENQTT QKGQKNSRER

781 MKRIEEGIKE LGSQILKEHP VENTQLQNEK LYLYYLQNGR DMYVDQELDI NRLSDYDVDA

841 IVPQSFLKDD SIDNKVLTRS DKNRGKSDNV PSEEVVKKMK NYWRQLLNAK LITQRKFDNL

901 TKAERGGLSE LDKAGFIKRQ LVETRQITKH VAQILDSRMN TKYDENDKLI REVKVITLKS

961 KLVSDFRKDF QFYKVREINN YHHAHDAYLN AVVGTALIKK YPKLESEFVY GDYKVYDVRK

1021 MIAKSEQEIG KATAKYFFYS NIMNFFKTEI TLANGEIRKR PLIETNGETG EIVWDKGRDF

1081 ATVRKVLSMP QVNIVKKTEV QTGGFSKESI LPKRNSDKLI ARKKDWDPKK YGGFDSPTVA

1141 YSVLVVAKVE KGKSKKLKSV KELLGITIME RSSFEKNPID FLEAKGYKEV KKDLIIKLPK

1201 YSLFELENGR KRMLASAGEL QKGNELALPS KYVNFLYLAS HYEKLKGSPE DNEQKQLFVE

1261 QHKHYLDEII EQISEFSKRV ILADANLDKV LSAYNKHRDK PIREQAENII HLFTLTNLGA

1321 PAAFKYFDTT IDRKPYTSTK EVLDATLIHQ SITGLYETRI DLSQLGGD.
```

Clo051 Endonuclease

An exemplary Clo051 nuclease domain may comprise, consist essentially of or consist of, the amino acid sequence of:

(SEQ ID NO: 17078)
EGIKSNISLLKDELRGQISHISHEYLSLIDLAFDSKQNRLF
EMKVLELLVNEYGFKGRHLGGSRKPDGIVYSTTLEDNFGII
VDTKAYSEGYSLPISQADEMERYVRENSNRDEEVNPNKWW
NFSEEVKKYYFVFISGSFKGKFEEQLRRLSMTTGVNGSAVN
WNLLLGAEKIRSGEMTIEELERAMFNNSEFILKY

Cas-Clover Fusion Protein

In certain embodiments, an exemplary dCas9-Clo051 fusion protein (embodiment 1) may comprise, consist essentially of or consist of, the amino acid sequence of (Clo051 sequence underlined, linker bold italics, dCas9 sequence (*Streptococcus pyogenes*) in italics):

(SEQ ID NO: 17079)
MAPKKKRKVEGIKSNISLLKDELRGQISHISHEYLSLIDLAFDSKQNRL
FEMKVLELLVNEYGFKGRHLGGSRKPDGIVYSTTLEDNFGIIVDTKAYS
EGYSLPISQADEMERYVRENSNRDEEVNPNKWWENFSEEVKKYYFVFIS
GSFKGKFEEQLRRLSMTTGVNGSAVNVVNLLLGAEKIRSGEMTIEELER
AMFNNSEFILKY*GGGGS**DKKYSIGLAIGTNSVGWAVITDEYKVPSKKF
KVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEK
YPTIYHLRKKLVDSTDKADLRLIYLALAHMIKFRGHFLIEGDLNPDNSD
VDKLFIQLVQTYNQLFEENPINASGVDAKAILSARLSKSRRLENLIAQL
PGEKKNGLFGNLIALSLGLTPNFKSNFDLAEDAKLQLSKDTYDDDLDNL
LAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFI
KPILEKMDGTEELLVKLNREDLLRKQRTFDNGSIPHQIHIGELHAILRR
QEDFYPFLKDNREKIEKILTFRIPYYVGPLARGNSRFAWMTRKSEETIT
PWNFEEVVDKGASAGSFIERMTNFDKNLPNEKVLPKHSLLYEYFTVYNE
LTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVL
TLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDS
LHEHIANLAGSPAIKKGILQTVKVVDELVKVMGRHKPENIVIEMARENQ
TTQKGQKNSRERMKRIEEGIKELGSQILKEHPVENTQLQNEKLYLYYLQ
NGRDMYVDQELDINRLSDYDVDAIVPQSFLKDDSIDNKVLTRSDKNRGK
SDNVPSEEVVKKMKNYWRQLLNAKLITQRKFDNLTKAERGGLSELDKAG
FIKRQLVETRQITKHVAQILDSRMNTKYDENDKLIREVKVITLKSKLVS
DFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPL
IETNGETGEIVWDXGRDFATVRKVLSMPQVNIVKKTEVQTGGFSKESIL
PKRNSDKLIARKKDWDPKKYGGFDSPTVAYSVLVVAKVEKGKSKKLKSV
KELLGITIMERSSFEKNPIDFLEAKGYKEVKKDLIIKLPKYSLFELENG
RKRMLASAGELQKGNELALPSKYVNFLYLASHYEKLKGSPEDNEQKQLF
VEQHKHYLDEIIEQISEFSKRVILADANLDKVLSAYNKHRDKPIREQAE
NIIHLFTLTNLGAPAAFKYFDTTIDRKRYTSTKEVLDATLIHQSITGLY
ETRIDLSQLGGDGSPKKKRKVSS.*

In certain embodiments, an exemplary dCas9-Clo051 fusion protein (embodiment 1) may comprise, consist essentially of or consist of, the nucleic acid sequence of (dCas9 sequence derived from *Streptococcus pyogenes*):

```
(SEQ ID NO: 17080)
  1 atggcaccaa agaagaaaag aaaagtggag ggcatcaagt caaacatcag cctgctgaaa
 61 gacgaactgc ggggacagat tagtcacatc agtcacgagt acctgtcact gattgatctg
121 gccttcgaca gcaagcagaa tagactgttt gagatgaaag tgctggaact gctggtcaac
181 gagtatggct tcaagggcag acatctgggc gggtctagga aacctgacgg catcgtgtac
241 agtaccacac tggaagacaa cttcggaatc attgtcgata ccaaggctta ttccgagggc
301 tactgtgtgc caattagtca ggcagatgag atggaaaggt acgtgcgcga aaactcaaat
361 agggacgagg aagtcaaccc caataagtgg tgggagaatt cagcgagga agtgaagaaa
421 tactacttcg tctttatctc aggcagcttc aaagggaagt ttgaggaaca gctgcggaga
481 ctgtccatga ctaccggggt gaacggatct gctgtcaacg tggtcaatct gctgctgggc
541 gcagaaaaga tcaggtccgg ggagatgaca attgaggaac tggaacgcgc catgttcaac
601 aattctgagt ttatcctgaa gtatggaggc ggggaagcg ataagaaata ctccatcgga
661 ctggccattg gcaccaattc cgtgggctgg gctgtcatca cagacgagta caaggtgcca
721 agcaagaagt tcaaggtcct ggggaacacc gatcgccaca gtatcaagaa aaatctgatt
781 ggagccctgc tgttcgactc aggcgagact gctgaagcaa cccgactgaa gcggactgct
```

```
 841 aggcgccgat atacccggag aaaaaatcgg atctgctacc tgcaggaaat tttcagcaac
 901 gagatggcca aggtggacga tagtttcttt caccgcctgg aggaatcatt cctggtggag
 961 gaagataaga aacacgagcg gcatcccatc tttggcaaca ttgtggacga agtcgcttat
1021 cacgagaagt accctactat ctatcatctg aggaagaaac tggtggactc caccgataag
1081 gcagacctgc gcctgatcta tctggccctg gctcacatga tcaagttccg ggggcatttt
1141 ctgatcgagg gagatctgaa ccctgacaat tctgatgtgg acaagctgtt catccagctg
1201 gtccagacat acaatcagct gtttgaggaa acccaattaa tgcctcagg cgtggacgca
1261 aaggccatcc tgagcgccag actgtccaaa tctaggcgcc tggaaaacct gatcgctcag
1321 ctgccaggag agaagaaaaa cggcctgttt gggaatctga ttgcactgtc cctgggcctg
1381 acacccaact tcaagtctaa ttttgatctg gccgaggacg ctaagctgca gctgtccaaa
1441 gacacttatg acgatgacct ggataacctg ctggctcaga tcggcgatca gtacgcagac
1501 ctgttcctgg ccgctaagaa tctgagtgac gccatcctgc tgtcagatat tctgcgcgtg
1561 aacacagaga ttactaaggc cccactgagt gcttcaatga tcaaaagata tgacgagcac
1621 catcaggatc tgaccctgct gaaggctctg gtgaggcagc agctgcccga gaaatacaag
1681 gaaatcttct tgatcagag caagaatgga tacgccggct atattgacgg cggggcttcc
1741 caggaggagt tctacaagtt catcaagccc attctggaaa agatggacgg caccgaggaa
1801 ctgctggtga agctgaatcg ggaggacctg ctgagaaaac agaggacatt tgataacgga
1861 agcatccctc accagattca tctgggcgaa ctgcacgcca tcctgcgacg gcaggaggac
1921 ttctacccat ttctgaagga taaccgcgag aaaatcgaaa agatcctgac cttcagaatc
1981 ccctactatg tggggcctct ggcacgggga aatagtagat tgcctggat gacaagaaag
2041 tcagaggaaa ctatcacccc ctggaacttc gaggaagtgg tcgataaagg cgctagcgca
2101 cagtccttca ttgaaaggat gacaaatttt gacaagaacc tgccaaatga aaggtgctg
2161 cccaaacaca gcgtgctgta cgaatatttc acagtgtata acgagctgac taaagtgaag
2221 tacgtcaccg aagggatgcg caagcccgca ttcctgtccg gagagcagaa gaaagccatc
2281 gtggacctgc tgtttaagac aaatcggaaa gtgactgtca acagctgaa ggaagactat
2341 ttcaagaaaa ttgagtgttt cgattcagtg gaaatcagcg gcgtcgagga caggtttaac
2401 gcctccctgg ggacctacca cgatctgctg aagatcatca aggataagga cttcctggac
2461 aacgaggaaa atgaggacat cctggaggac attgtgctga cactgactct gtttgaggat
2521 cgcgaaatga tcgaggaacg actgaagact tatgcccatc tgttcgatga caaagtgatg
2581 aagcagctga aagaaggcg ctacaccgga tgggacgcc tgagccgaaa actgatcaat
2641 gggattagag acaagcagag cggaaaaact atcctggact ttctgaagtc cgatggcttc
2701 gccaacagga acttcatgca gctgattcac gatgactctc tgaccttcaa ggaggacatc
2761 cagaaagcac aggtgtctgg ccaggggac agtctgcacg agcatatcgc aaacctggcc
2821 ggcagccccg ccatcaagaa agggattctg cagaccgtga aggtggtgga cgaactggtc
2881 aaggtcatgg gacgacacaa acctgagaac atcgtgattg agatggcccg cgaaaatcag
2941 acaactcaga agggccagaa aaacagtcga gaacggatga gagaatcga ggaaggcatc
3001 aaggagctgg ggtcacagat cctgaaggag catcctgtgg aaaacactca gctgcagaat
3061 gagaaactgt atctgtacta tctgcagaat ggacgggata tgtacgtgga ccaggagctg
3121 gatattaaca gactgagtga ttatgacgtg gatgccatcg tccctcagag cttcctgaag
3181 gatgactcca ttgacaacaa ggtgctgacc aggtccgaca agaaccgcgg caaatcagat
3241 aatgtgccaa gcgaggaagt ggtcaagaaa atgaagaact actggaggca gctgctgaat
```

-continued

```
3301  gccaagctga tcacacagcg gaaatttgat aacctgacta aggcagaaag aggaggggtg
3361  tctgagctgg acaaggccgg cttcatcaag cggcagctgg tggagacaag acagatcact
3421  aagcacgtcg ctcagattct ggatagcaga atgaacacaa agtacgatga aaacgacaag
3461  ctgatcaggg aggtgaaagt cattactctg aaatccaagc tggtgtctga ctttagaaag
3541  gatttccagt tttataaagt cagggagatc aacaactacc accatgctca tgacgcatac
3601  ctgaacgcag tggtcgggac cgccctgatt aagaaatacc ccaagctgga gtccgagttc
3661  gtgtacggag actataaagt gtacgatgtc cggaagatga tcgccaaatc tgagcaggaa
3721  attggcaagg ccaccgctaa gtatttcttt tacagtaaca tcatgaattt ctttaagacc
3781  gaaatcacac tggcaaatgg ggagatcaga aaaaggcctc tgattgagac caacggggag
3841  acaggagaaa tcgtgtggga caagggaagg gattttgcta ccgtgcgcaa agtcctgtcc
3901  atgccccaag tgaatattgt caagaaaact gaagtgcaga ccggggggatt ctctaaggag
3961  agtattctgc ctaagcgaaa ctctgataaa ctgatcgccc ggaagaaaga ctgggacccc
4021  aagaagtatg gcgggttcga ctctccaaca gtggcttaca gtgtcctggt ggtcgcaaag
4081  gtggaaaagg ggaagtccaa gaaactgaag tctgtcaaag agctgctggg aatcactatt
4141  atggaacgca gctccttcga gaagaatcct atcgattttc tggaagccaa gggctataaa
4201  gaggtgaaga agacctgat cattaagctg ccaaaatact cactgtttga gctggaaaac
4261  ggacgaaagc gaatgctggc aagcgccgga gaactgcaga agggcaatga gctggccctg
4321  ccctccaaat acgtgaactt cctgtatctg gctagccact acgagaaact gaaggggtcc
4381  cctgaggata cgaacagaa gcagctgttt gtggagcagc acaaacatta tctggacgag
4441  atcattgaac agatttcaga gttcagcaag agagtgatcc tggctgacgc aaatctggat
4501  aaagtcctga gcgcatacaa caagcaccga gacaaaccaa tccgggagca ggccgaaaat
4561  atcattcatc tgttcacccct gacaaacctg ggcgcccctg cagccttcaa gtattttgac
4621  accacaatcg atcggaagag atacacttct accaaagagg tgctggatgc taccctgatc
4681  caccgagta ttaccggcct gtatgagaca cgcatcgacc tgtcacagct gggaggcgat
4741  gggagcccca agaaaaagcg gaaggtgtct agttaa
```

In certain embodiments, the nucleic acid sequence encoding a dCas9-Clo051 fusion protein (embodiment 1) of the disclosure may comprise a DNA. In certain embodiments, the nucleic acid sequence encoding a dCas9-Clo051 fusion protein (embodiment 1) of the disclosure may comprise an RNA.

In certain embodiments, an exemplary dCas9-Clo051 fusion protein (embodiment 2) may comprise, consist essentially of or consist of, the amino acid sequence of (Clo051 sequence underlined, linker bold italics, dCas9 sequence (*Streptococcus pyogenes*) in italics):

```
                                    (SEQ ID NO: 17081)
  1  MPKKKRKVEG IKSNISLLKD ELRGQISHIS HEYLSLIDLA
     FDSKQNPLFE MKVLELLVNE
 61  YGFKGRHLGG SRKPDGIVYS TTLEDNFGII VDTKAYSEGY
     SLPISQADEM ERYVRENSNR
121  DEEVNPNKWW ENFSEEVKKY YFVFISGSFK GKFEEQLRRL
     SMTTGVNGSA VNVVNLLLGA
```

-continued

```
181  EKIRSGEMTI EELERAMFNN SEFILKYGGG GSDKKYSIGL
     AIGTNSVGWA VITDEYKVPS
241  KKFKVLGNTD RHSIKKNLIG ALLFDSGETA EATRLKRTAR
     RRYTRRFNRI CYLQEIFSNE
301  MAKVDDSFFH RLEESFLVEE DKKHERHPIF GNIVDEVAYH
     EKYPTIYHLR KKLVDSTDKA
361  DLRLIYLALA HMIKFRGHFL IEGDLNPDNS DVDKLFIQLV
     QTYNQLFEEN PINASGVDAK
421  AILSARLSKS RRLENLIAQL PGEKKNGLFG NLIALSLGLT
     PNFKSNFDLA EDAKLQLSKD
481  TYDDDLDNLL AQIGDQYADL FLAAKNLSDA ILLSDILRVN
     TEITKAPLSA SMIKRYDEHH
541  QDLTLLKALV RQQLPEKYKE IFFDQSKNGY AGYIDGGASQ
     EEFYKFIKPI LEKMDGTEEL
```

```
601 LVKLNREDLL RKQRTFDNGS IPHQIHLGEL HAILRRQEDF
    YPFLKDNREK IEKILTFRIP
661 YYVGPLARGN SRFAWMTRKS EETITPWNFE EVVDKGASAQ
    SFIERMTNFD KNLPNEKVLP
721 KHSLLYEYFT VYNELTKVKY VTEGMRKPAF LSGEQEEAIV
    DLLFKTNRKV TVKQLKEDYF
781 KKIECFDSVE ISGVEDRFNA SLGTYHDLLK IIKDKDFLDN
    EENEDILEDI VLTLTLFEDR
841 EMIEERLKTY AHLFDDKVMK QLKRRRYTGW GRLSRKLING
    IRDKQSGKTI LDFLKSDGFA
901 NRNFMQLIHD DSLTFKEDIQ KAQVSGQGDS LHEHIANLAG
    SPAIKKGILQ TVKVVDELVK
961 VMGRHKPENI VIEMARENQT TQKGQKNSRE RMKRIEEGIK
    ELGSQILKEH PVENTQLQNE
1021 KLYLYYLQNG RDMYVDQELD INRLSDYDVD AIVPQSFLKD
     DSIDNKVLTR SDKNRGKSDN
1061 VPSEEVVKKM KNYWRQLLNA KLITQRKFDN LTKAERGGLS
     ELDKAGFIKR QLVETRQITK
1141 HVAQILDSRM NTKYDENDKL IREVKVITLK SKLVSDFRKD
     FQFYKVREIN NYHHAHDAYL
1201 NAVVGTALIK KYPKLESEFV YGDYKVYDVR KMIAKSEQEI
     GKATAKYFFY SNIMNFFKTE
1261 ITLANGEIRK RPLIETNGET GEIVWDKGRD FATVRKVLSM
     PQVNIVKKTE VQTGGFSKES
1321 ILPKRNSDKL IARKKDWDPK KYGGFDSPTV AYSVLVVAKV
     EKGKSKKLKS VKELLGITIM
1381 ERSSFEKNPI DFLEAKGYKE VKKDLIIKLP KYSLFELENG
     RKRMLASAGE LQKGNELALP
1441 SKYVNFLYLA SHYEKLKGSP EDNEQKQLFV EQHKHYLDEI
     IEQISEFSKR VILADANLDK
1501 VLSAYNKHRD KPIREQAENI IHLFTLTLNG APAAFKYFDT
     TIDRKRYTST KEVLDATLIH
1561 QSITGLYETR IDLSQLGGDG SPKKKRKV.
```

In certain embodiments, an exemplary dCas9-Clo051 fusion protein (embodiment 2) may comprise, consist essentially of or consist of, the nucleic acid sequence of (dCas9 sequence derived from *Streptococcus pyogenes*):

(SEQ ID NO: 17082)
```
   1 atgcctaaga agaagcggaa ggtggaaggc atcaaaagca acatctccct cctgaaagac
  61 gaactccggg ggcagattag ccacattagt cacgaatacc tctccctcat cgacctggct
 121 ttcgatagca agcagaacag gctctttgag atgaaagtgc tggaactgct cgtcaatgag
 181 tacgggttca agggtcgaca cctcggcgga tctaggaaac cagacggcat cgtgtatagt
 211 accacactgg aagacaactt tgggatcatt gtggatacca aggcatactc tgagggttat
 301 agtctgccca tttcacaggc cgacgagatg gaacggtacg tgcgcgagaa ctcaaataga
 361 gatgaggaag tcaaccctaa caagtggtgg gagaacttct ctgaggaagt gaagaaatac
 421 tacttcgtct ttatcagcgg gtccttcaag ggtaaatttg aggaacagct caggagactg
 481 agcatgacta ccggcgtgaa tggcagcgcc gtcaacgtgg tcaatctgct cctgggcgct
 541 gaaaagattc ggagcgagaa gatgaccatc gaagagctgg agagggcaat gtttaataat
 501 agcgagttta tcctgaaata cggtggcggt ggatccgata aaaagtattc tattggttta
 661 gccatcggca ctaattccga tggatgggct gtcataaccg atgaatacaa agtaccttca
 721 aagaaattta aggtgttggg aacacagac cgtcattcga ttaaaaagaa tcttatcggt
 781 gccctcctat tcgatagtgg cgaaacggca gaggcgactc gcctgaaacg aaccgctcgg
 841 agaaggtata cacgtcgcaa gaaccgaata tgttacttac aagaaatttt tagcaatgag
 901 atggccaaag ttgacgattc tttctttcac cgtttggaag agtccttcct tgtcgaagag
 961 gacaagaaac atgaacggca ccccatcttt ggaaacatag tagatgaggt ggcatatcat
1021 gaaaagtacc caacgattta tcacctcaga aaaaagctag ttgactcaac tgataaagcg
1081 gacctgaggt taatctactt ggctcttgcc catatgataa agttccgtgg gcactttctc
1141 attgagggtg atctaaatcc ggacaactcg gatgtcgaca aactgttcat ccagttagta
```

```
1201  caaacctata atcagttgtt tgaagagaac cctataaatg caagtggcgt ggatgcgaag
1261  gctattctta gcgcccgcct ctctaaatcc cgacggctag aaaacctgat cgcacaatta
1321  cccggagaga agaaaaatgg gttgttcggt aaccttatag cgctctcact aggcctgaca
1381  ccaaatttta agtcgaactt cgacttagct gaagatgcca aattgcagct tagtaaggac
1441  acgtacgatg acgatctcga caatctactg gcacaaattg gagatcagta tgcggactta
1501  tttttggctg ccaaaaacct tagcgatgca atcctcctat ctgacatact gagagttaat
1561  actgagatta ccaaggcgcc gttatccgct tcaatgatca aaaggtacga tgaacatcac
1621  caagacttga cacttctcaa ggccctagtc cgtcagcaac tgcctgagaa atataaggaa
1681  atattctttg atcagtcgaa aaacgggtac gcaggttata ttgacggcgg agcgagtcaa
1741  gaggaattct acaagtttat caaacccata ttagagaaga tggatgggac ggaagagttg
1801  cttgtaaaac tcaatcgcga agatctactg cgaaagcagc ggactttcga caacggtagc
1861  attccacatc aaatccactt aggcgaattg catgctatac ttagaaggca ggaggatttt
1921  tatccgttcc tcaaagacaa tcgtgaaaag attgagaaaa tcctaacctt tcgcatacct
1981  tactatgtgg gaccccctggc ccgagggaac tctcggttcg catgatgac aagaaagtcc
2041  gaagaaacga ttactccatg gaattttgag gaagttgtcg ataaaggtgc gtcagctcaa
2101  tcgttcatcg agaggatgac caactttgac aagaatttac cgaacgaaaa agtattgcct
2161  aagcacagtt tactttacga gtatttcaca gtgtacaatg aactcacgaa agttaagtat
2221  gtcactaagg gcatgcgtaa acccgccttt ctaagcgaag aacagaagaa agcaatagta
2281  gatctgttat tcaagaccaa ccgcaaagtg acagttaagc aattgaaaga ggactacttt
2341  aagaaaattg aatgcttcga ttctgtcgag atctccgggg tagaagatcg atttaatgcg
2401  tcacttggta cgtatcatga cctcctaaag ataattaaag ataaggactt cctggataac
2461  gaagagaatg aagatatctt agaagatata gtgttgactc ttaccctctt tgaagatcgg
2521  gaaatgattg aggaaagact aaaaacatac gctcacctgt tcgacgataa ggttatgaaa
2581  cagttaaaga ggcgtcgcta tacgggctgg ggacgattgt cgcggaaact tatcaacggg
2641  ataagagaca agcaaagtgg taaaactatt ctcgattttc taaagagcga cggcttcgcc
2701  aataggaact ttatgcagct gatccatgat gactctttaa ccttcaaaga ggatatacaa
2761  aaggcacagg tttccggaca aggggactca ttgcacgaac atattgcgaa tcttgctggt
2821  tcgccagcca tcaaaaaggg catactccag acagtcaaag tagtggatga gctagttaag
2881  gtcatgggac gtcacaaacc ggaaaacatt gtaatcgaga tggcacgcga aaatcaaacg
2941  actcagaagg ggcaaaaaaa cagtcgagag cggatgaaga aatagaaga gggtattaaa
3001  gaactgggca gccagatctt aaaggagcat cctgtggaaa tacccaattg cagaacgag
3061  aaactttacc tctattacct acaaaatgga agggacatgt atgttgatca ggaactggac
3121  ataaaccgtt tatctgatta cgacgtcgat gccattgtac cccaatcctt tttgaaggac
3181  gattcaatcg acaataaagc gcttacacgc tcggataaga accgagggaa aagtgacaat
3241  gttccaagcg aggaagtcgt aaagaaaatg aagaactatt ggcggcagct cctaaatgcg
3301  aaactgataa cgcaaagaaa gttcgataac ttaactaaag ctgagagggg tggcttgtct
3361  gaacttgaca aggccggatt tattaaacgt cagctcgtgg aaacccgcca aatcacaaag
3421  catgttgcac agatactaga ttcccgaatg aatacgaaat acgacgagaa cgataagctg
3481  attcgggaag tcaaagtaat cactttaaag tcaaaattgg tgtcggactt cagaaaggat
3541  tttcaattct ataaagttag ggagataaat aactaccacc atgcgcacga cgcttatctt
```

-continued
```
3601 aatgccgtcg tagggaccgc actcattaag aaatacccga agctagaaag tgagtttgtg 3661 tatggtgatt acaaagttta tgacgtccgt aagatgatcg cgaaaagcga acaggagata 3721 ggcaaggcta cagccaaata cttcttttat tctaacatta tgaatttctt taagacggaa 3781 atcactctgg caaacggaga gatacgcaaa cgacctttaa ttgaaaccaa tggggagaca 3841 ggtgaaatcg tatgggataa gggccgggac ttcgcgacgg tgagaaaagt tttgtccatg 3901 ccccaagtca acatagtaaa gaaaactgag gtgcagaccg gagggttttc aaaggaatcg 3961 attcttccaa aaaggaatag tgataagctc atcgctcgta aaaaggactg ggacccgaaa 4021 aagtacggtg gcttcgatag ccctacagtt gcctattctg tcctagtagt ggcaaaagtt 4081 gagaagggaa aatccaagaa actgaagtca gtcaaagaat tattggggat aacgattatg 4141 gagcgctcgt cttttgaaaa gaacccatc gacttccttg aggcgaaagg ttacaaggaa 4201 gtaaaaaagg atctcataat taaactacca aagtatagtc tgtttgagtt agaaaatggc 4261 cgaaaacgga tgttggctag cgccggagag cttcaaaagg ggaacgaact cgcactaccg 4321 tctaaatacg tgaatttcat gtatttagcg tcccattacg agaagttgaa aggttcacct 4381 gaagataacg aacagaagca acttttttgtt gagcagcaca aacattatct cgacgaaatc 4441 atagagcaaa tttcggaatt cagtaagaga gtcatcctag ctgatgccaa tctggacaaa 4501 gtattaagcg catacaacaa gcacagggat aaacccatac gtgagcaggc ggaaaatatt 4561 atccatttgt ttactcttac caacctcggc gctccagccg cattcaagta ttttgacaca 4621 acgatagatc gcaaacgata cacttctacc aaggaggtgc tagacgcgac actgattcac 4681 caatccatca cgggattata tgaaactcgg atagatttgt cacagcttgg gggtgacgga 4741 tcccccaaga agaagaggaa agtctga.
```

In certain embodiments, the nucleic acid sequence encoding a dCas9-Clo051 fusion protein (embodiment 2) of the disclosure may comprise a DNA. In certain embodiments, the nucleic acid sequence encoding a dCas9-Clo051 fusion protein (embodiment 2) of the disclosure may comprise an RNA.

EXAMPLES

Example 1: Design of NF-KB Inducible Vectors for Expression in Modified T-Cells

Two T cell activation NF-KB inducible vectors were developed (FIGS. 1A and B); one with the gene expression system (GES) in the forward orientation (A) and the other in the complementary direction (B), both preceding the constitutive EF1a promoter. These vectors also direct expression of a CAR molecule and a DHFR selection gene, separated by a T2A sequence. Both the conditional NF-KB inducible system and the EF1a directed genes are a part of a piggyBac transposon which can be permanently integrated into T cells using EP. Once integrated into the genome, the T cells constitutively express the CAR on the membrane surface and the DHFR within the cell, while expression of the NF-KB inducible gene, GFP, will be expressed to the highest level only upon T cell activation.

Example 2: NF-KB Inducible Vectors for GFP Expression in Modified T-Cells

Figure 2:
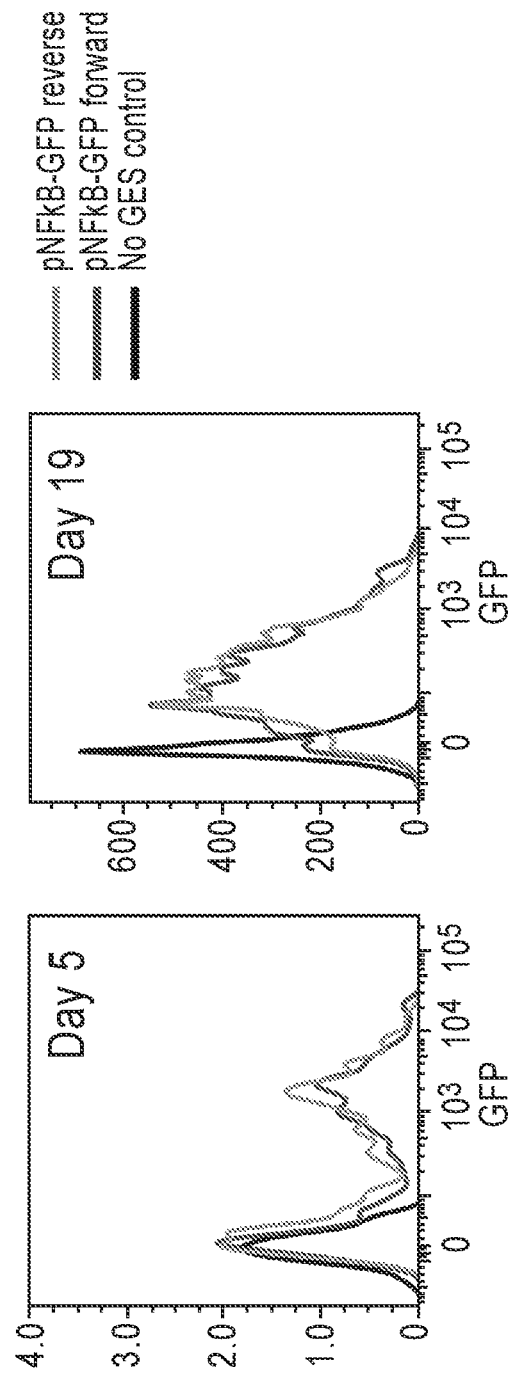
FIG. 2 is a pair of graphs depicting NF-KB inducible expression of GFP in activated T cells. T cells were nucleofected with a piggyBac vector expressing an anti-BCMA CAR and a DHFR mutein gene under control of an EF1a promoter along with the absence (No GES control) or presence of an NF-KB inducible expression system driving GFP expression in either the forward (pNFKB-GFP forward) or reverse orientation (pNFKB-GFP reverse). Cells were cultured in the presence of methotrexate selection until the cells were almost completely resting (Day 19) and GFP expression was assessed at Day 5 and Day 19. At Day 5, all T cells are proliferating and highly stimulated, with cells harboring the NF-KB inducible expression cassette producing high levels of GFP due to strong NFκB activity. The No GES control cells did not express detectable levels of GFP. By Day 19, the GES T cells were almost fully resting and GFP expression was significantly lower than Day 5 (~⅛ MFI), since NFκB activity is lower. GFP expression is still observed at Day 19, which may due to the long half-life of GFP protein (~30 hr), or, basal level of NFκB activity through, for example, a TCR, a CAR, a cytokine receptor, or a growth factor receptor signal.

T cells were nucleofected with a piggyBac vector expressing an anti-BCMA CAR and a DHFR mutein gene under control of an EF1a promoter along with the absence (No gene expression system (GES) control) or presence of an NF-KB inducible expression system driving GFP expression in either the forward (pNFKB-GFP forward) or reverse orientation (pNFKB-GFP reverse). Cells were cultured in the presence of methotrexate selection until the cells were almost completely resting (Day 19) and GFP expression was assessed at Day 5 and Day 19. At Day 5, all T cells are proliferating and highly stimulated, with cells harboring the NF-KB inducible expression cassette producing high levels of GFP due to strong NFκB activity (see FIG. 2). The No GES control cells did not express detectable levels of GFP. By Day 19, the GES T cells were almost fully resting and GFP expression was significantly lower than Day 5 (~⅛ MFI), since NFκB activity is lower. GFP expression is still observed at Day 19, which may due to the long half-life of GFP protein (~30 hr), or, basal level of NFκB activity through, for example, a TCR, a CAR, a cytokine receptor, or a growth factor receptor signal.

Figure 3:
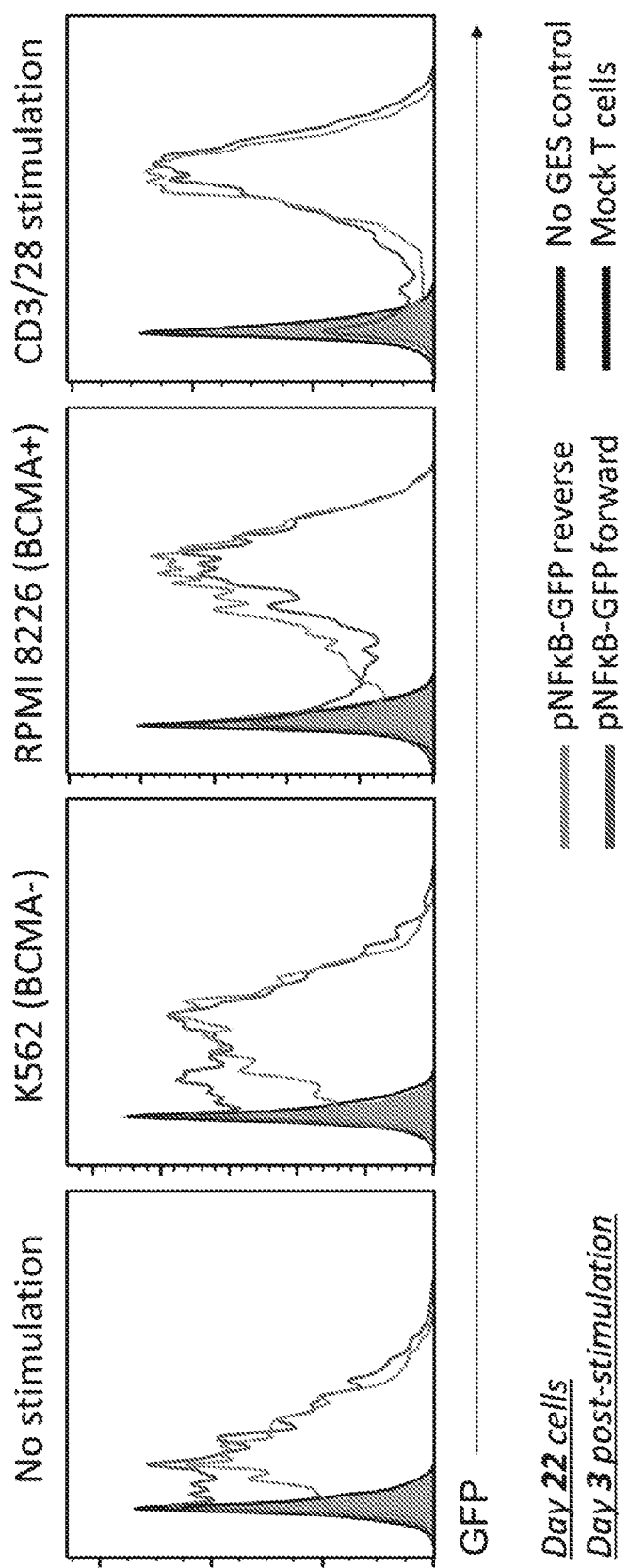
FIG. 3 is a series of graphs depicting anti-BCMA CAR-mediated activation of NF-KB inducible expression of GFP in presence of BCMA+ tumor cells. T cells were either unmodified (Mock T cells) or nucleofected with a piggyBac vector expressing an anti-BCMA CAR and a DHFR mutein gene under control of an EF1a promoter along with the absence (No GES control) or presence of an NF-KB inducible expression system driving GFP expression in either the forward (pNFKB-GFP forward) or reverse orientation (pNFKB-GFP reverse). All cells were cultured for 22 days, either with or without methotrexate selection (Mock T cells), until the cells were almost completely resting. Cells were then stimulated for 3 days in the absence (No stimulation) or presence of BCMA− (K562), BMCA+ (RPMI 8226), or positive control anti-CD3 anti-CD28 activation reagent (CD3/28 stimulation). GFP expression was undetectable under all conditions with the No GES control or Mock T cells. However, while pNFKB-GFP forward- and reverse-transposed cells exhibited little GFP expression over the No stimulation control when cultured with BCMA− K562 cells, they both demonstrated dramatic upregulation of gene expression either in the presence of BCMA+ tumor cells or under positive control conditions. Little difference in GFP expression was observed between the pNFKB-GFP forward- and reverse-transposed cells that were cocultured with BCMA+ tumor cells.

Example 3: NF-KB Inducible Vectors for Anti-BCMA CAR-Mediated GFP Expression in Modified T-Cells T cells were either unmodified (Mock T cells) or nucleofected with a piggyBac vector expressing an anti-BCMA CAR and a DHFR mutein gene under control of an EF1a promoter along with the absence (No gene expression system (GES) control) or presence of an NF-KB inducible expression system driving GFP expression in either the forward (pNFKB-GFP forward) or reverse orientation (pNFKB-GFP reverse). All cells were cultured for 22 days, either with or without methotrexate selection (Mock T cells), until the cells were almost completely resting. Cells were then stimulated for 3 days in the absence (No stimulation) or presence of BCMA– (K562). BMCA+ (RPMI 8226), or positive control anti-CD3 anti-CD28 activation reagent (CD3/28 stimulation). GFP expression was undetectable under all conditions with the No GES control or Mock T cells. However, while pNFKB-GFP forward- and reverse-transposed cells exhibited little GFP expression over the No stimulation control when cultured with BCMA– K562 cells, they both demonstrated dramatic upregulation of gene expression either in the presence of BCMA+ tumor cells or under positive control conditions (FIG. 3). Little difference in GFP expression was observed between the pNFKB-GFP forward- and reverse-transposed cells that were cocultured with BCMA+ tumor cells.

Example 4: Control of Anti-BCMA CAR-Mediated Expression in Modified T-Cells

Figure 4:
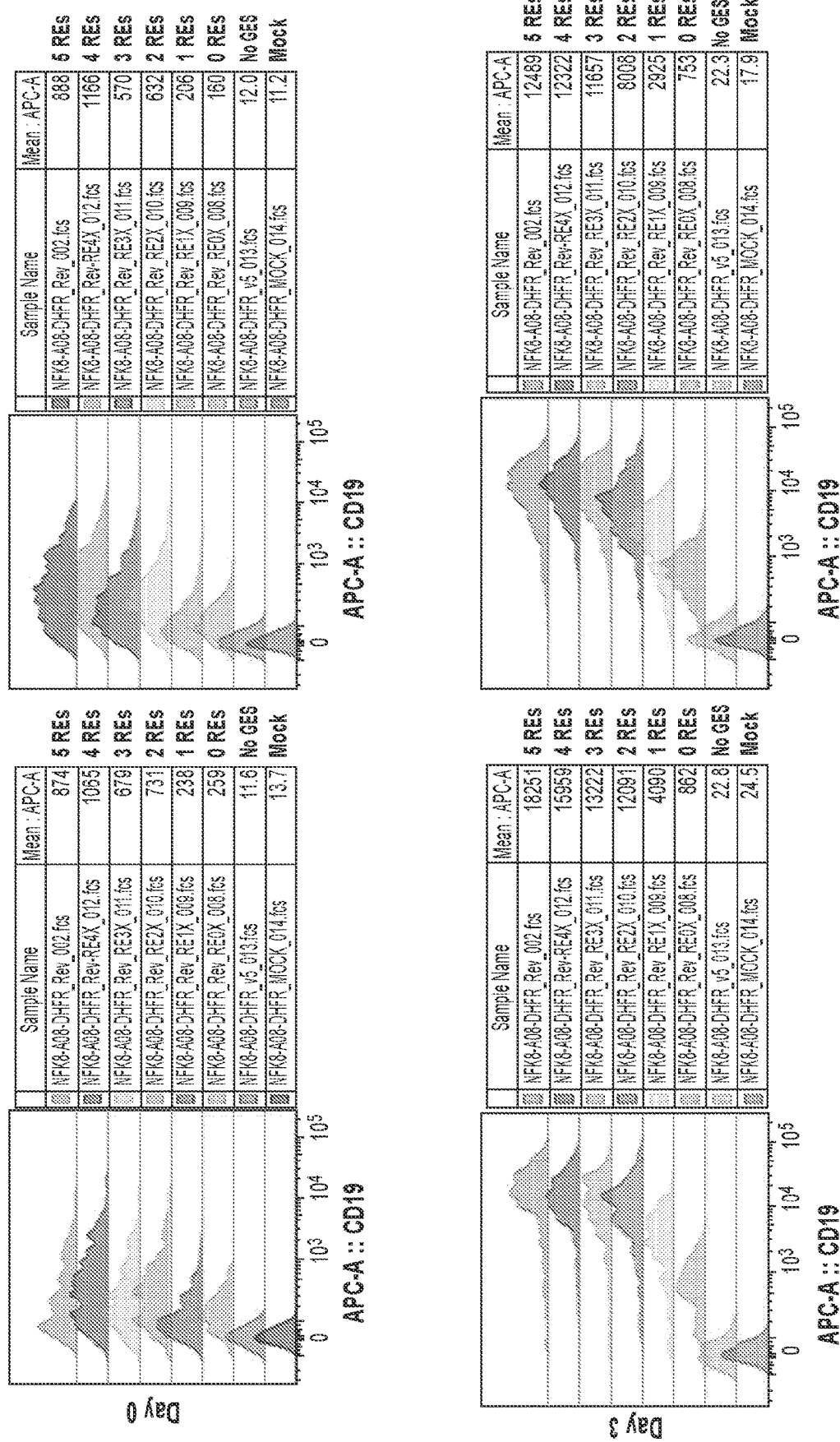
FIG. 4 is a series of graphs demonstrating that the Expression level of inducible gene can be regulated by number of response elements preceding the promoter T cells were nucleofected with a piggyBac vector encoding an anti-BCMA CARTyrin followed by a selection gene, both under control of a human EF1a promoter. Further, vectors either additionally encoded the conditional NF-KB inducible gene expression system driving expression of a truncated CD19 protein (dCD19) and included a number of NFKB response elements (RE) varying from 0-5, no GES (No GES), or received an electroporation pulse but no piggyBac nucleic acid (Mock). Data are shown for only the GES in the reverse (opposite) direction/orientation. All cells were cultured for 18 days and included selection for piggy-Bac-modified T cells using methotrexate addition. Cells were then stimulated for 3 days using anti-CD3 anti-CD28 bead activation reagent and dCD19 surface expression was assessed by FACS at Days 0, 3 and 18, and data are shown as FACS histograms and MF of target protein staining. Surface dCD19 expression was detected at low levels at Day 0 in all T cells transposed with vectors encoding the GES. At 3 days post-stimulation, dramatic upregulation of dCD19 expression was observed for all T cells expressing the GES, with a greater fold increase in surface expression in those with higher numbers of REs. Thus, surface dCD19 expression was directly proportional with the number of REs encoded in the GES. No dCD19 was detected on the surface of T cells that did not harbor the GES: No GES and Mock controls.
Figure 4:
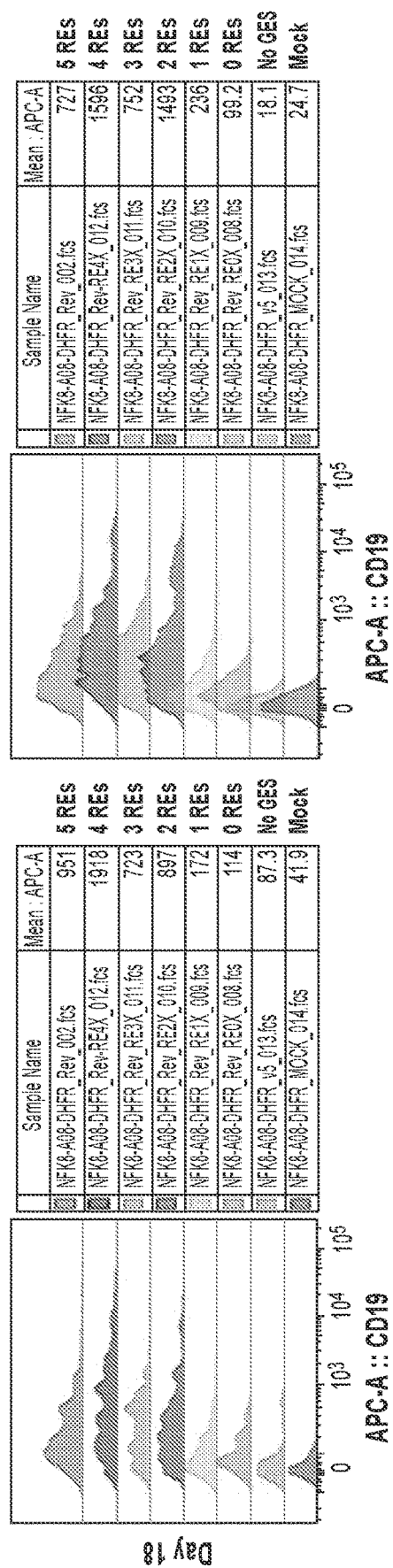
Figure 4:
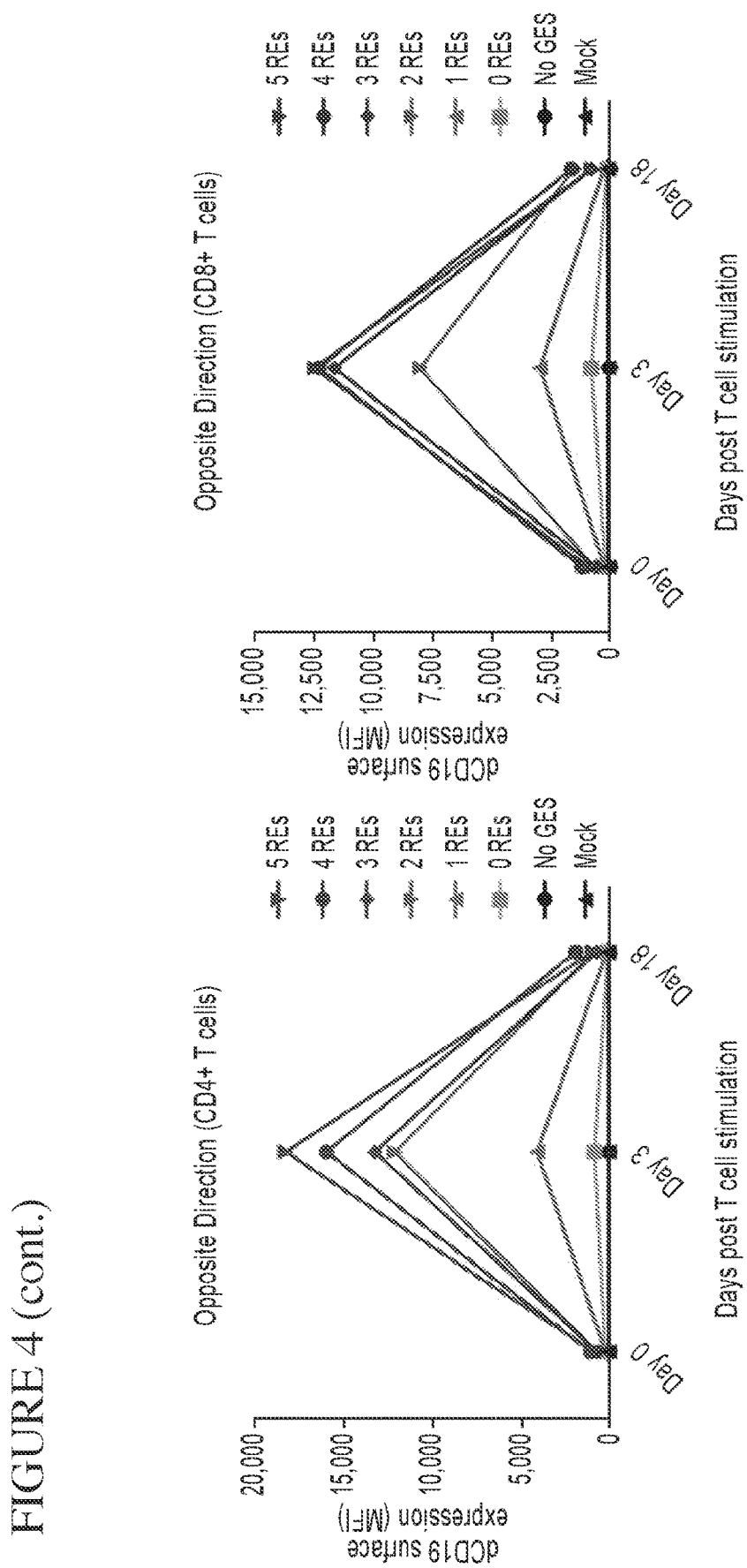

The expression level of inducible gene can be regulated by the number of response elements upstream or preceding the inducible promoter. T cells were nucleofected with a piggyBac vector encoding an anti-BCMA CARTyrin followed by a selection gene, both under control of a human EF a promoter (FIG. 4). Further, vectors either additionally encoded the conditional NF-KB inducible gene expression system driving expression of a truncated CD19 protein (dCD19) and included a number of NFκB response elements (RE) varying from 0-5, no GES (No GES), or received an electroporation pulse but no piggyBac nucleic acid (Mock). Data are shown for only the GES in the reverse (opposite) direction/orientation. All cells were cultured for 18 days and included selection for piggyBac-modified T cells using methotrexate addition. Cells were then stimulated for 3 days using anti-CD3 anti-CD28 bead activation reagent and dCD19 surface expression was assessed by FACS at Days 0, 3 and 18, and data are shown as FACS histograms and MFI of target protein staining. Surface dCD19 expression was detected at low levels at Day 0 in all T cells transposed with vectors encoding the GES. At 3 days post-stimulation, dramatic upregulation of dCD19 expression was observed for all T cells expressing the GES, with a greater fold increase in surface expression in those with higher numbers of REs. Thus, surface dCD19 expression was directly proportional with the number of REs encoded in the GES. No dCD19 was detected on the surface of T cells that did not harbor the GES: No GES and Mock controls.

Example 5: Expression of Human Factor IX in Modified T-Cells

Figure 5:
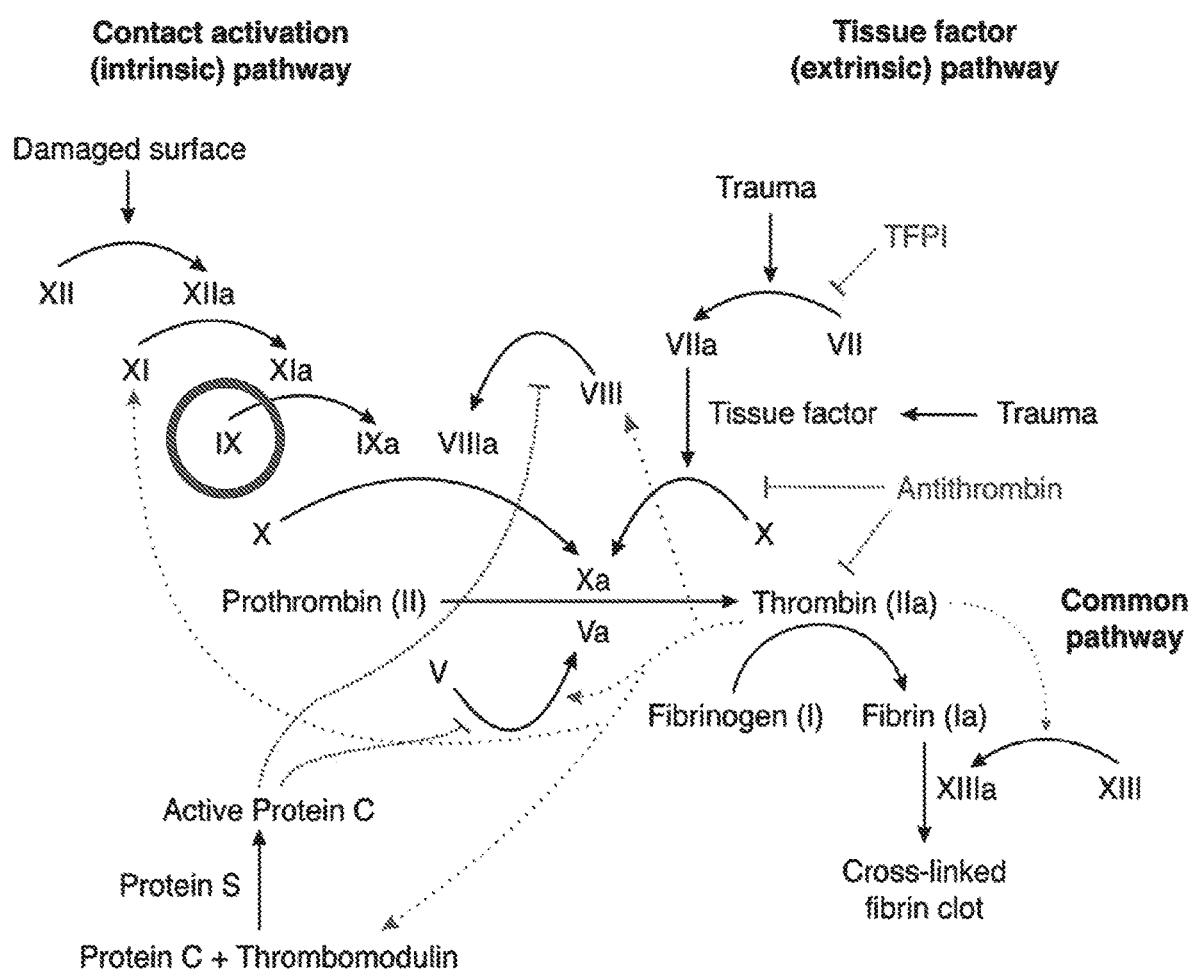
FIG. 5 is a schematic diagram showing the human coagulation pathway leading to blood clotting. Contact activation, for example by damaging an endothelium, activates an intrinsic clotting pathway. Tissue factors activate an extrinsic clotting pathway, for example following trauma Both pathways converge onto the conversion of Prothrombin into Thrombin, which catalyzes the conversion of fibrinogen into fibrin. Polymerized fibrin together with platelets forms a clot. In the absence of Factor IX (circled), clotting is defective. Factor VII (FVIII) deficiency leads to development of Hemophilia A. Factor IX (FIX) deficiency leads to development of Hemophilia B. Prior to the compositions and methods of the disclosure, the standard treatment for hemophilia B involved an infusion of recombinant FIX every 2 to 3 days, at an expense of approximately $250,000 per year. In sharp contrast to this standard treatment option, T cells of the disclosure are maintained in humans for several decades.

Genetic deficiencies in Factor IX (FIG. 5) lead to a life threatening disease called Hemophilia B. Hemophilia B is a rare disease that affects between 1 in 25,000 and 1 in 30,000 people. Prior to the development of the compositions and methods of the disclosure, the standard treatment for Hemophilia B involved an infusion of recombinant Factor IX protein every 2-3 days, at a cost of around $250,000 per year.

Figure 6:
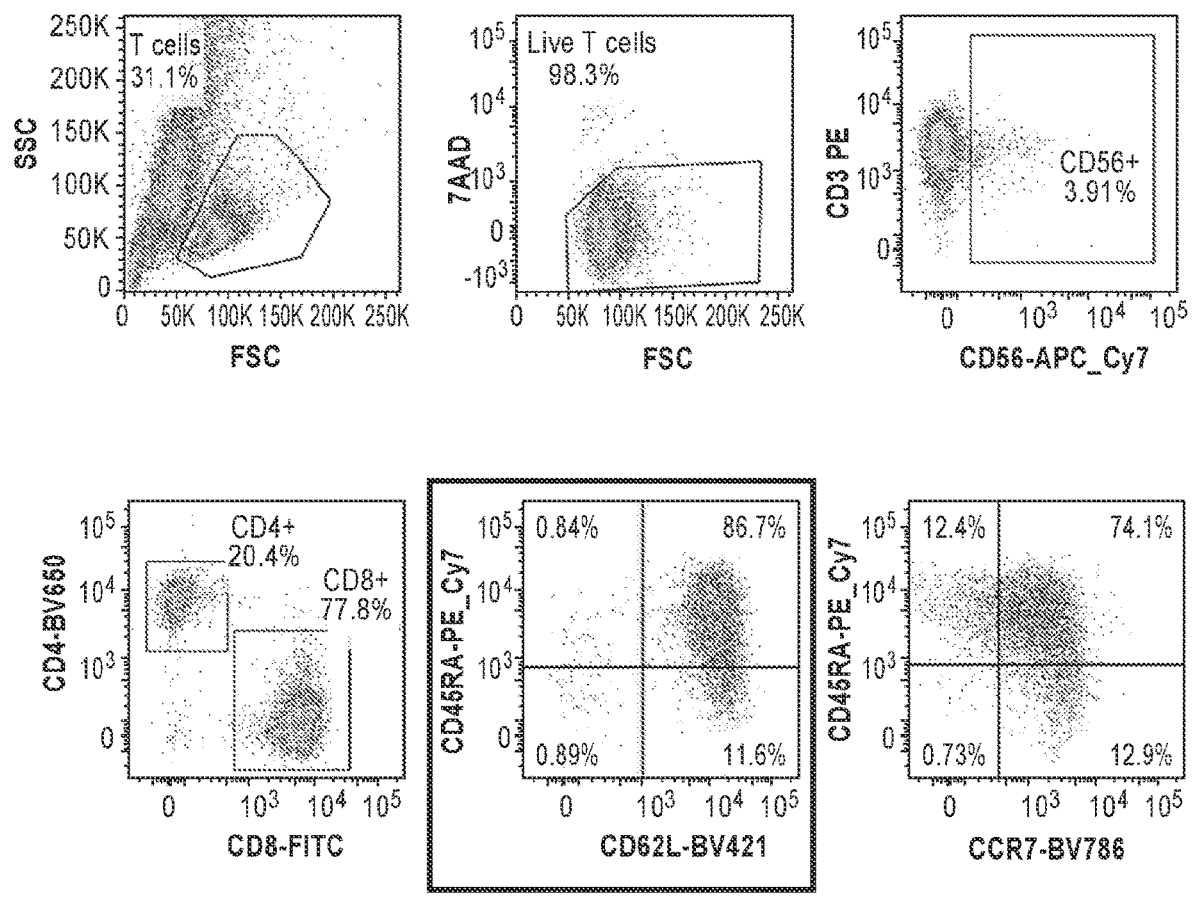
FIG. 6 is a series of Fluorescence-Activated Cell Sorting (FACS plots) depicting FIX-secreting T cells. T cells encoding a human Factor IX transgene showed a T-cell phenotype in approximately 80% of cells. The 6 panels are described in order from left to right. (1) Forward scatter (FSC) on the x-axis versus side scatter (SSC) on the y-axis. The x-axis is from 0 to 250 thousand (abbreviated k) in increments of 50k, the y-axis is for 0 to 250k, in increments of 50k. (2) FSC on the x-axis versus the cell viability marker 7 aminoactinomycin D (7AAD). The x-axis is labeled from 0 to 250k in increments of 50k. The y-axis reads, from top to bottom, $-10^3$, 0, $10^3$, $10^4$, $10^5$. (3) On the x-axis is shown anti-CD56-APC conjugated to a Cy7 dye (CDC156-APC-Cy7), units from 0 to $10^5$ incrementing in powers of 10. On the y-axis is shown anti-CD3 conjugated to phycoerythrin (PE), units from 0 to $10^5$ incrementing in powers of 10. (4) On the x-axis is shown anti-CD8 conjugated to fluorescein isothiocyanate (FITC), units from 0 to $10^5$ incrementing in powers of 10. On the y-axis is shown anti-CD4 conjugated to Brilliant Violet 650 dye (BV650), units from 0 to $10^5$ incrementing in powers of 10. (5) On the x-axis is shown an anti CD62L antibody conjugated to a Brilliant Violet 421 dye (BV421), units from 0 to $10^5$ incrementing in powers of 10 On the y-axis is shown an anti-CD45RA antibody conjugated to PE and Cy7, units from 0 to $10^5$ incrementing in powers of 10. This panel is boxed. (6) On the x-axis is shown an anti-CCR7 antibody conjugated to Brilliant Violet 786 (BV786), units from 0 to 10 incrementing in powers of 10. On the y-axis is shown anti-CD45RA conjugated to PE and Cy7, units from 0 to $10^5$ incrementing in powers of 10.
Figure 7A:
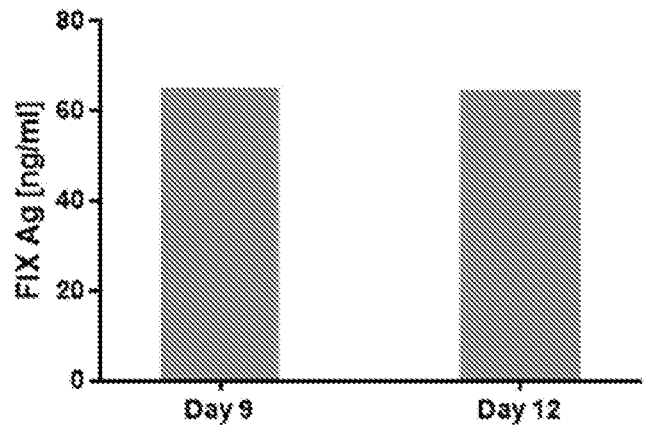
FIG. 7A is a graph showing human Factor IX secretion during production of modified T cells of the disclosure. On the y-axis, Factor IX concentration in nanograms (ng) per milliliter (mL) from 0 to 80 in increments of 20. On the x-axis are shown 9 day and 12 day T cells.
Figure 7B:
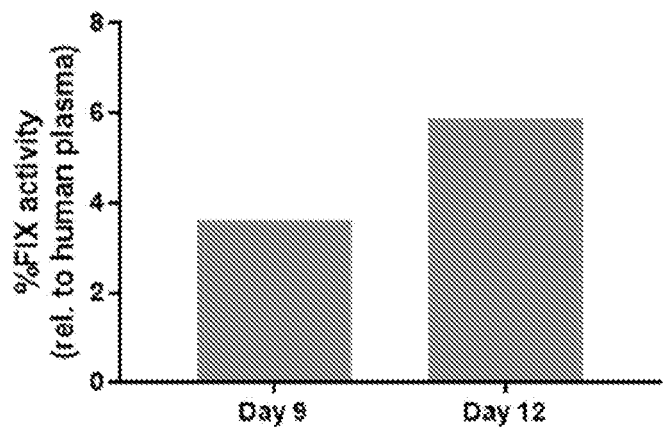
FIG. 7B is a graph showing the clotting activity of the secreted Factor IX produced by the T cells. On the y-axis is shown percent Factor IX activity relative to human plasma, from 0 to 8 in increments of 2. On the x-axis are 9 and 12 day T cells.
Figure 9:
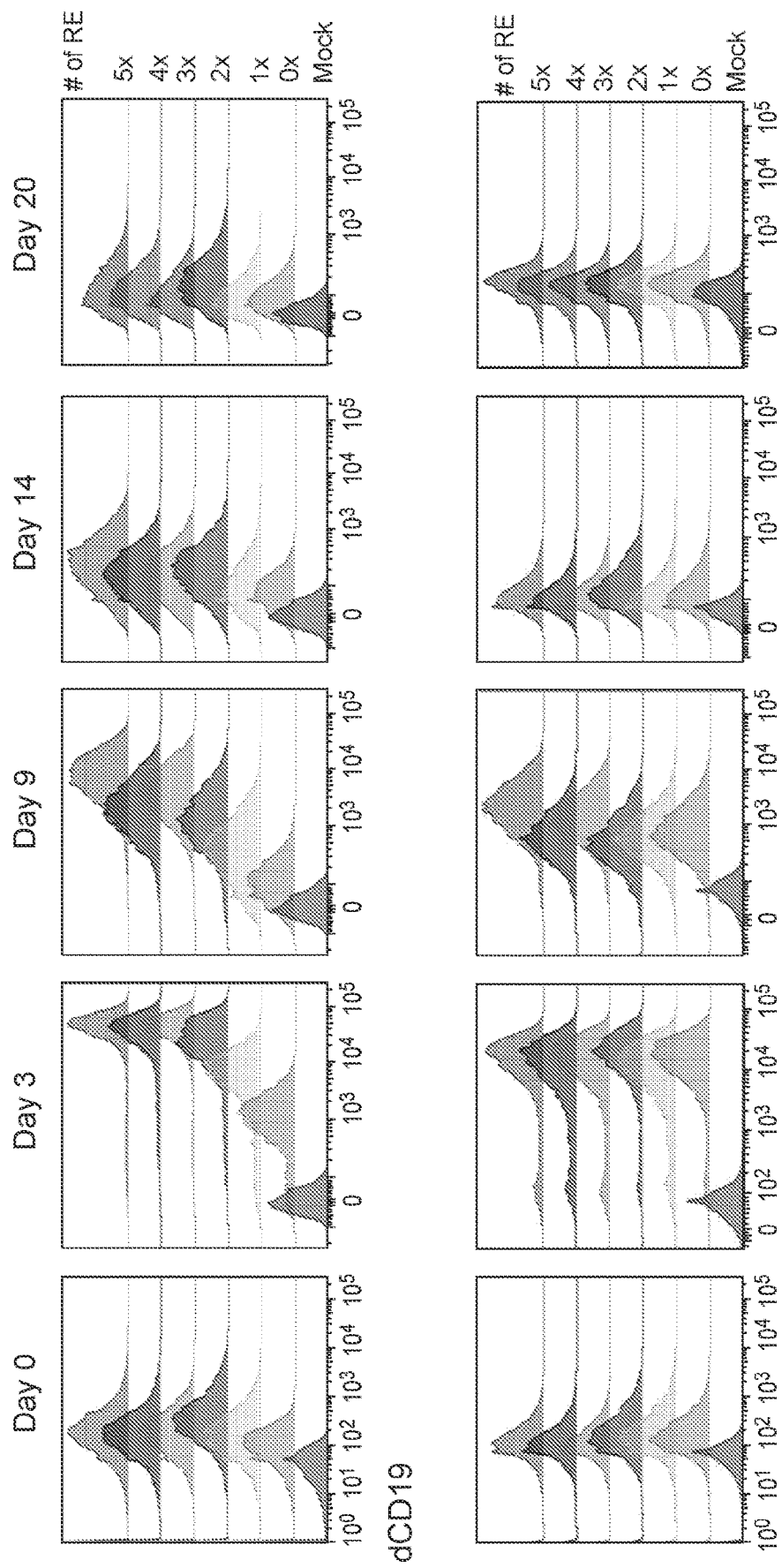
FIG. 9 is a series of graphs demonstrating that the expression level of inducible gene can be regulated by number of response elements preceding the promoter in CD8 positive cells. Truncated CD19 (dCD19) expressing CAR-T cells were stimulated by BCMA+ H929 multiple myeloma cells at 2:1 CAR-T:H929 ratio. The expression of dCD19 was driven by the minimal promoter that enhanced by 0, 1, 2, 3, 4 or 5 repeats of the NF-kB response element. The expression of BCMA CAR was driven by human elongation factor-1α (EF-1α) promoter, a constitutive promoter that is commonly used for gene expression in human T cells. Before tumor cell stimulation, the expression of CAR and dCD19 were both at basal levels compared to mock T cell control. The expression levels of CAR and dCD19 were both upregulated upon tumor stimulation (day 3) and then subsequently downregulated (day 9, 14) and eventually reached their respective basal levels when the cells resume a fully rested status again (day 20). However, CAR surface expression was equivalently up- or down-regulated in all the CAR-T cell samples during cell activation and resting process, while the expression levels of dCD19 were directly proportional to the number of NF-κB response elements (day 3, 9, 14). Data are shown as FACS histograms and MFI of target protein staining. Thus, surface dCD19 expression was directly proportional with the number of REs encoded in the GES. No dCD19 was detected on the surface of T cells that did not harbor the GES: No GES and Mock controls.

T cells are maintained in humans for several decades, and are therefore an ideal vehicle to secrete Factor IX, supplying the Factor IX missing in Hemophilia B patients without the need for frequent transfusions. T cells were transposed with PiggyBac to secrete Factor IX. When transgenic T cells encoding a human Factor IX transgene were examined for T cell markers using FACS (FIG. 6). These modified T cells were able to secrete human Factor IX (FIG. 7A), and this secreted Factor LX provided clotting activity (FIG. 7B).

Figure 10:
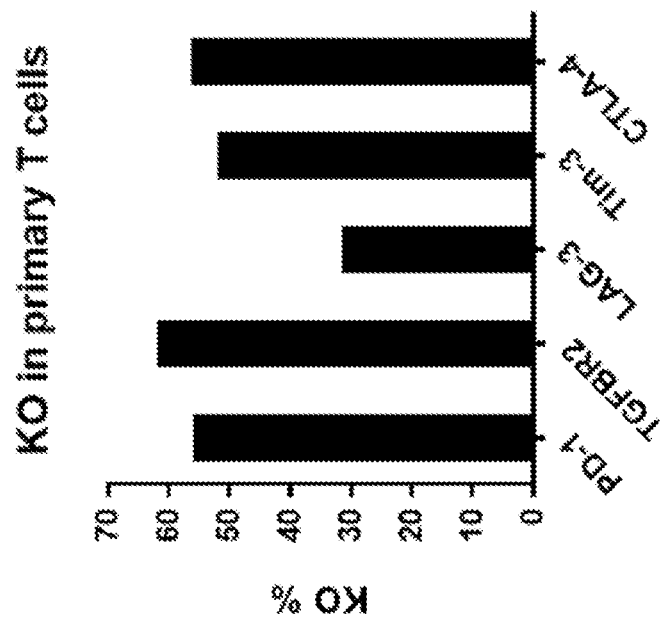
FIG. 10 is a bar graph depicting the knock out efficiency of targeting various checkpoint signaling proteins that could be used to armor T-cells. Cas-CLOVER was used to knock-out the checkpoint receptors. PD-1, TGFBR2, LAG-3, TIM-3 and CTLA-4 in resting primary human pan T cells. Percent knock-out is shown on the y-axis. Gene editing resulted in 30-70% loss of protein expression at the cell surface as measured by flow cytometry.

Example 6: Knock Down Efficiency of Checkpoint Signaling Proteins on Armored T-Cells Another strategy to produce armored T-cells is to reduce or inhibit endogenous checkpoint signaling by expressing various modified/chimeric checkpoint receptors that have an altered or absent intracellular signaling domain. One mechanism to produce armored T-cells is to inhibit checkpoint signaling is to knockout various checkpoint receptors. The Cas-CLOVER™ platform was used to target and knockout the checkpoint receptors PD-1, TGFβR2, LAG-3, Tim-3, and CTLA-4 in resting (or quiescent) primary pan T cells. As measured by flow cytometry, gene editing resulted in 30-70% loss of protein expression at the cell surface (FIG. 10). These results show that Cas-CLOVER™ is able to efficiently target the knockout of these genes resulting in loss of target protein expression on the T-cell surface. Knockout efficiency can significantly be increased by further optimization of guide RNA pairs, or by using additional guide RNA pairs targeting the same gene and/or regulators or promoters of the target gene.

Figure 11:
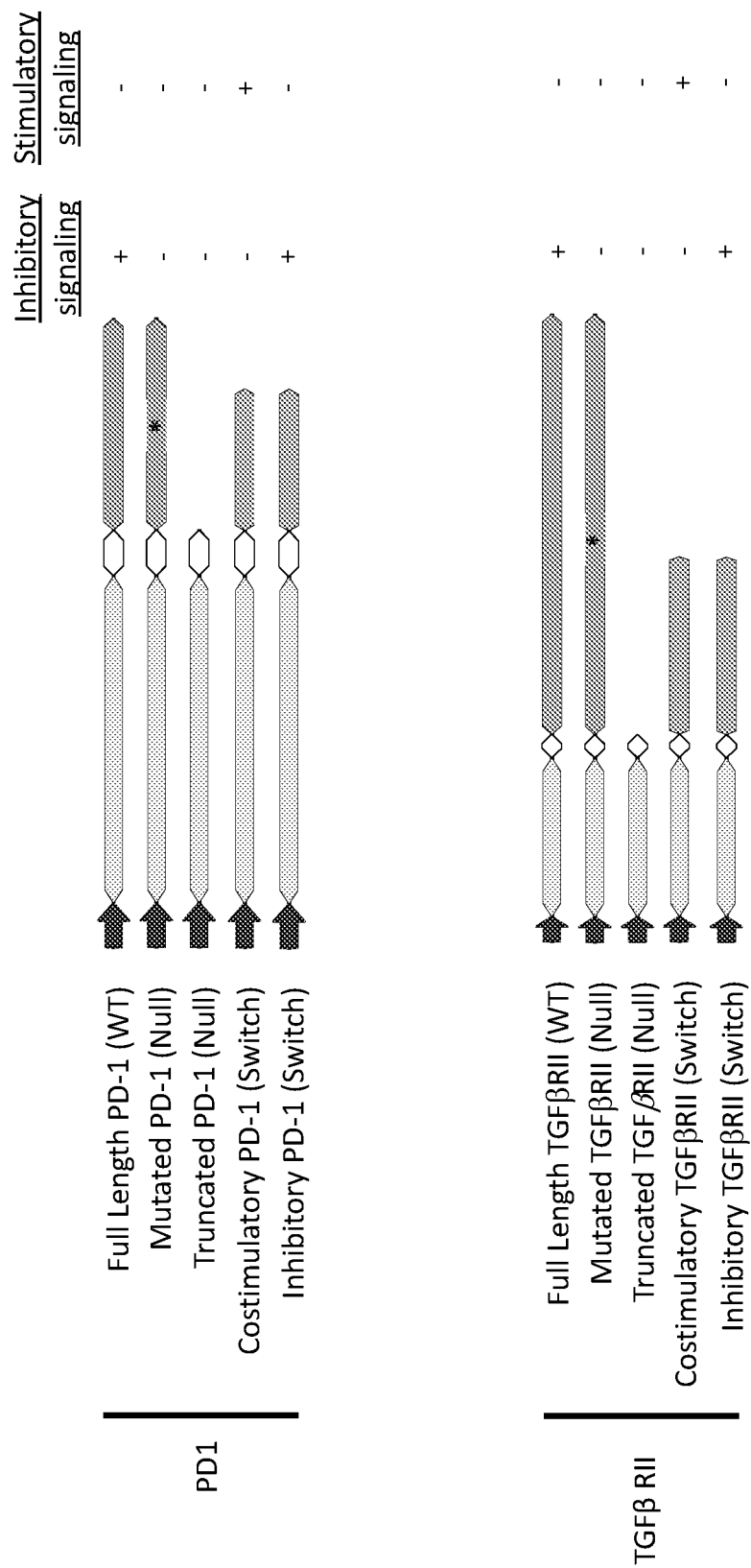
FIG. 11 is a series of schematic diagrams of wildtype, null and switch receptors and their effects on intracellular signaling, either inhibitory or stimulatory, in primary T-cells. Binding of the wildtype inhibitory receptor expressed endogenously on a T-cell with its endogenous ligand results in transmission of an inhibitory signal which, in part, reduces T-cell effector function. However, mutation (Mutated null) or deletion (Truncated null) of the intracellular domain (ICD) of a checkpoint receptor protein, such as PD1 (top panel) or TGFBRII (bottom panel), reduces or eliminates its signaling capability when cognate ligand(s) is bound. Thus, expression of engineered mutated or truncated null receptors on the surface of modified T cells results in a competition with endogenously-expressed wildtype receptors for binding of the free endogenous ligand(s), effectively reducing or eliminating delivery of inhibitory signals by endogenously-expressed wildtype receptors. Specifically, any binding by a mutated or null receptor sequesters the endogenous ligand(s) from binding the wildtype receptor and results in dilution of the overall level of checkpoint signaling effectively delivered to the modified T-cell, thereby reducing or blocking checkpoint inhibition and functional exhaustion of the modified T cells. A switch receptor is created by replacement of the wildtype ICD with an ICD from either a co-stimulatory molecule (such as CD3z, CD28, 4-1BB) or a different inhibitory molecule (such as CTLA4, PD1, Lag3). In the former case, binding of the endogenous ligand(s) by the modified switch receptor results in the delivery of a positive signal to the T-cells, thereby helping to enhance stimulation of the modified T cell and potentially enhance target tumor cell killing. In the latter case, binding of the endogenous ligand(s) by the modified switch receptor results in the delivery of a negative signal to the T-cells, thereby eliminating stimulation of the modified T cell and potentially reducing target tumor cell killing. The signal peptide (purple arrow), extracellular domain (ECD) (bright green), transmembrane domain (yellow), intracellular signaling domain (ICD)(orange), and replacement ICD (green) are displayed in the receptor diagrams. "*" indicates a mutated ICD. "+" indicates the presence of a checkpoint signal. "−" indicates the absence of a checkpoint signal.

Example 7: Strategies for the Expression of Null or Switch Intracellular Signaling Proteins on Armored T-Cells Another strategy to produce armored T-cells is to reduce or inhibit endogenous checkpoint signaling by expressing various modified/chimeric checkpoint receptors that have an altered or absent intracellular signaling domain. Checkpoint signals that could be targeted using this strategy include PD-1 or TGFβRII of T-cells, which bind to the PD-L1 ligand and TGFβ cytokine, respectively. FIG. 11 shows a schematic diagram of various strategies for producing decoy/null/dominant negative receptor (Null receptors) for two different inhibitory receptors (PD-1 (top panel) and TGFβRII (bottom panel)). To design Null receptors, the intracellular domain (ICD) of PD1 or TGFβRII can be mutated (mutated null) or deleted (truncated null). As a result, binding of the cognate ligand(s) of the null receptor does not result in delivery of the checkpoint signal to the T-cells. Furthermore, since the Null receptor competes with wildtype receptors for binding of the endogenous ligand(s), any binding by the Null receptor sequesters endogenous ligand(s) from binding the wildtype receptor. This results in dilution of the overall level of checkpoint signaling effectively delivered to the T-cell, thus, reducing or blocking checkpoint inhibition. FIG. 11 also shows switch receptor design strategies for the inhibitory receptors PD-1 (top panel) and TGFβRII (bottom panel). In switch receptors, wildtype ICD is replaced with the ICD from either an immuno-stimulatory molecule (Co-stimulatory switch) or a different inhibitory molecule (Inhibitory switch). Immuno-stimulatory molecules include but are not limited to CD3z, CD28, 4-1BB and the examples listed in Table 2. Inhibitory molecules include but are not limited to CTLA4, PD1, Lag3 and the examples listed in Table 2. In the former case, binding of the endogenous ligand by the modified switch receptor results in the delivery of a positive signal to the T-cells, thereby helping to enhance stimulation of the T-cell, facilitating continuation of tumor targeting and killing. In the latter case, binding of the endogenous ligand by the modified switch receptor results in the delivery of a negative signal to the T-cells, thereby helping to reduce stimulation and activity of the T-cell.

Figure 12:
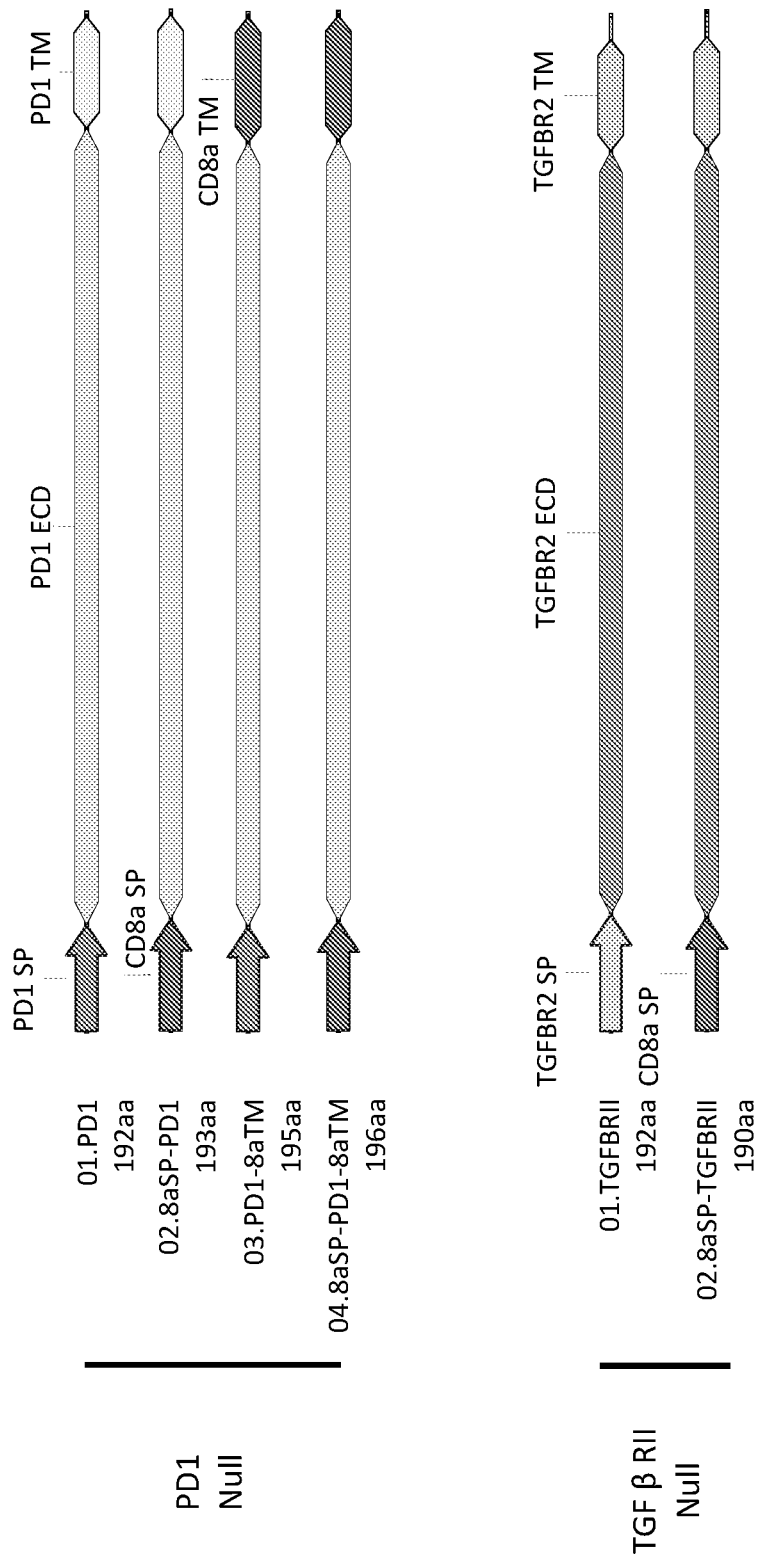
FIG. 12 is a schematic diagram showing an example of the design of null receptors with specific alterations that may help to increase expression of the receptor on the surface of modified T cells. Examples are shown for PD1 and TGFBRII null receptors and the signal peptide domain (SP), transmembrane domain (TM) and extracellular domain (ECD) of truncated null receptors for PD1 (top panel) and TGFBRII (bottom panel) are displayed. The first of the top four molecules is the wildtype PD-1 receptor, which encodes the wildtype PD-1 SP and TM. For the PD1 null receptor, replacement of PD1 wildtype SP or TM domain (green; light green) with the SP or TM domain of a human T cell CD8a receptor (red) is depicted. The second molecule encodes the CD8a SP along with the native PD-1 TM, the third encodes the wildtype PD-1 SP and the alternative CD8a TM, and the fourth encodes both the alternative CD8a SP and TM. Similarly, for the null receptor of TGFβRII, replacement of the wildtype TGFBRII SP (pink) with a SP domain of a human T cell CD8a receptor (red). The names of the constructs and the amino acid lengths (aa) of each construct protein is listed on the left of the diagram.
Figure 13:
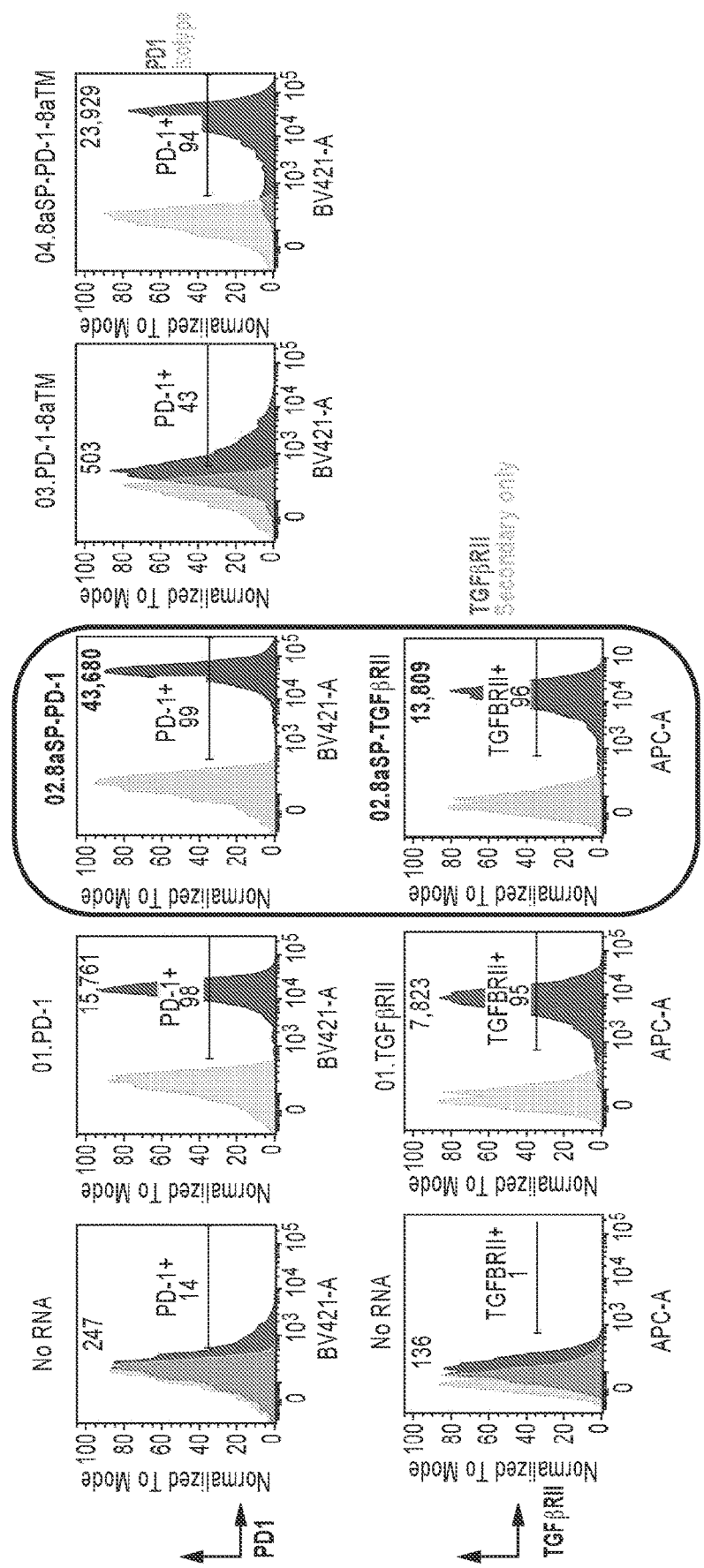
FIG. 13 is a series of histograms depicting the expression of the PD1 and TGFBRII null Receptors on the surface of modified primary human T cells as determined by flow cytometry. Each of the six truncated null constructs from FIG. 12 were expressed on the surface of primary human T cells. T cells were stained with either anti-PD1 (top; blue histograms) or anti-TGFβRII (bottom; blue histograms), or isotype control or secondary only (gray histograms). Cells staining positive for PD-1 or TGFβRII expression were gated (frequency shown above gate) and mean fluorescence intensity (MFI) value is displayed above each positive histogram. The names of the null receptor constructs are depicted above each plot. Both null receptor gene strategies, replacement of the wildtype SP with the alternative CD8α were successfully expressed. 02.8aSP-PD- and 02.8aSP-TGFβRII resulted in the highest level of expression at the T-cell surface. 02.8aSP-PD-1 null receptor exhibited an MFI of 43,680, which is 177-fold higher than endogenous T cell PD-1 expression and 2.8-fold higher than the wildtype PD-1 null receptor. 02.8aSP-TGFβRII null receptor exhibited an MFI of 13,809, which is 102-fold higher than endogenous T cell TGFβRII expression and 1.8-fold higher than the wildtype TGFβRII null receptor. Replacement of wildtype SP with the alternative CD8α SP for both PD1 and TGRBRII results in enhanced surface expression of the null or Switch receptor, which may help to maximize reduction or blockage of checkpoint inhibition upon binding and sequestration of the endogenous ligand(s).
Figure 14:
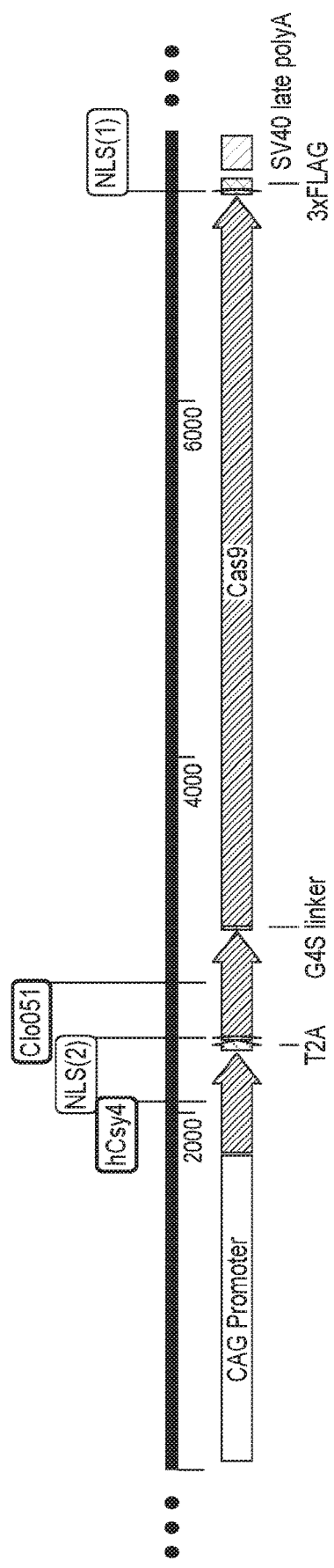
FIG. 14 is a schematic depiction of the Csy4-T2A-Clo051-G4Slinker-dCas9 construct map (Embodiment 2).
Figure 15:
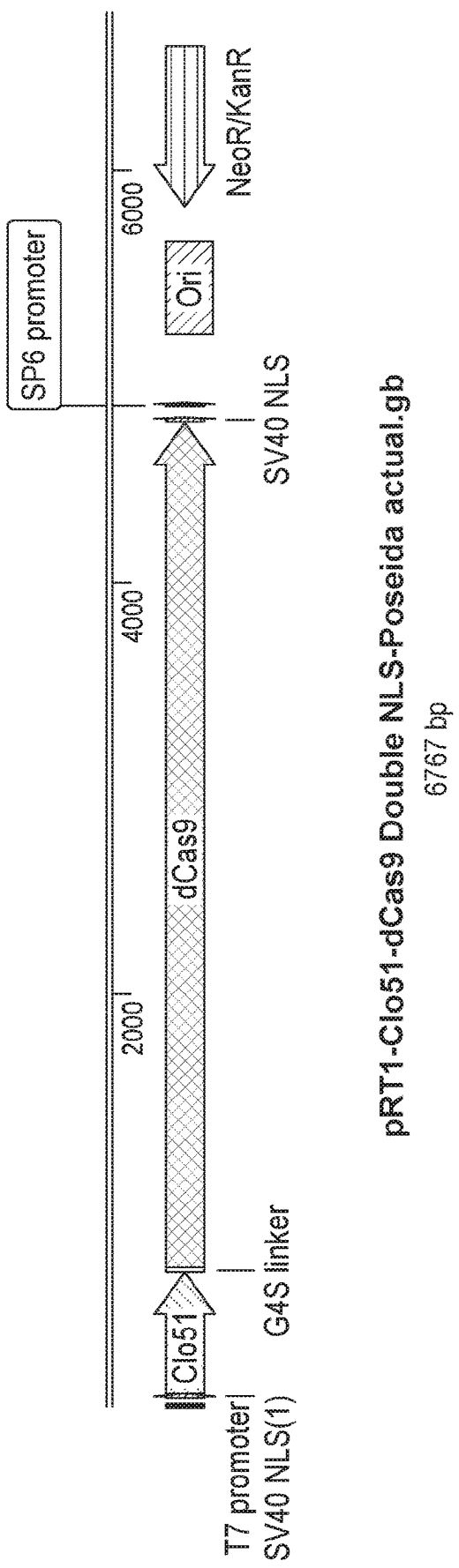
FIG. 15 is a schematic depiction of the pRT-Clo051-dCas9 Double NLS construct map (Embodiment 1).
Figure 16:
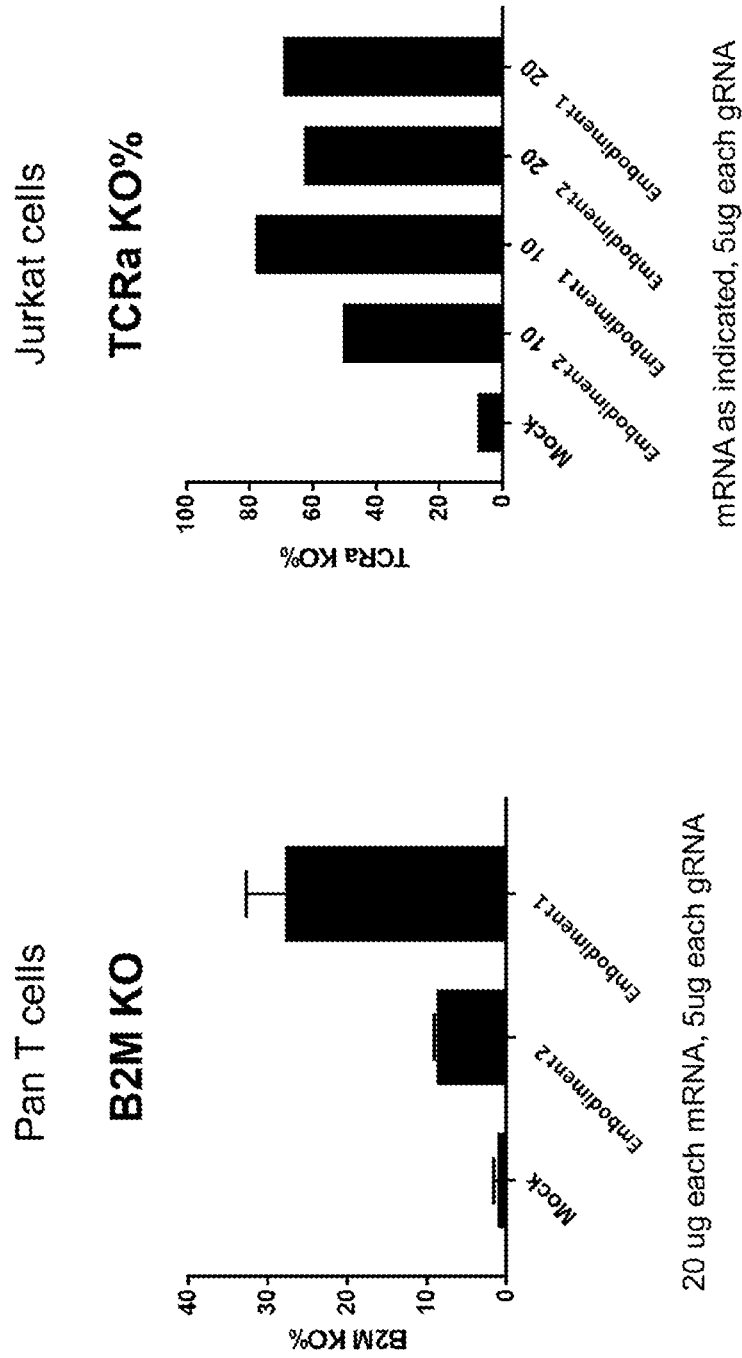
FIG. 16 is a pair of graphs comparing the efficacy of knocking out expression of either B2M on the surface of Pan T-cells (left) or the α-chain of the T-cell Receptor on the surface of Jurkat cells (right) for either Embodiment 1 (pRT1-Clo051-dCas9 Double NLS, as shown in FIG. 15) or Embodiment 2 (Csy4-T2A-Clo051-G4Slinker-dCas9, as shown in FIG. 14) of a Cas-Clover fusion protein of the disclosure. For the right-hand graph, the fusion protein is provided at either 10 μg or 20 μg, as indicated.
Figure 17:
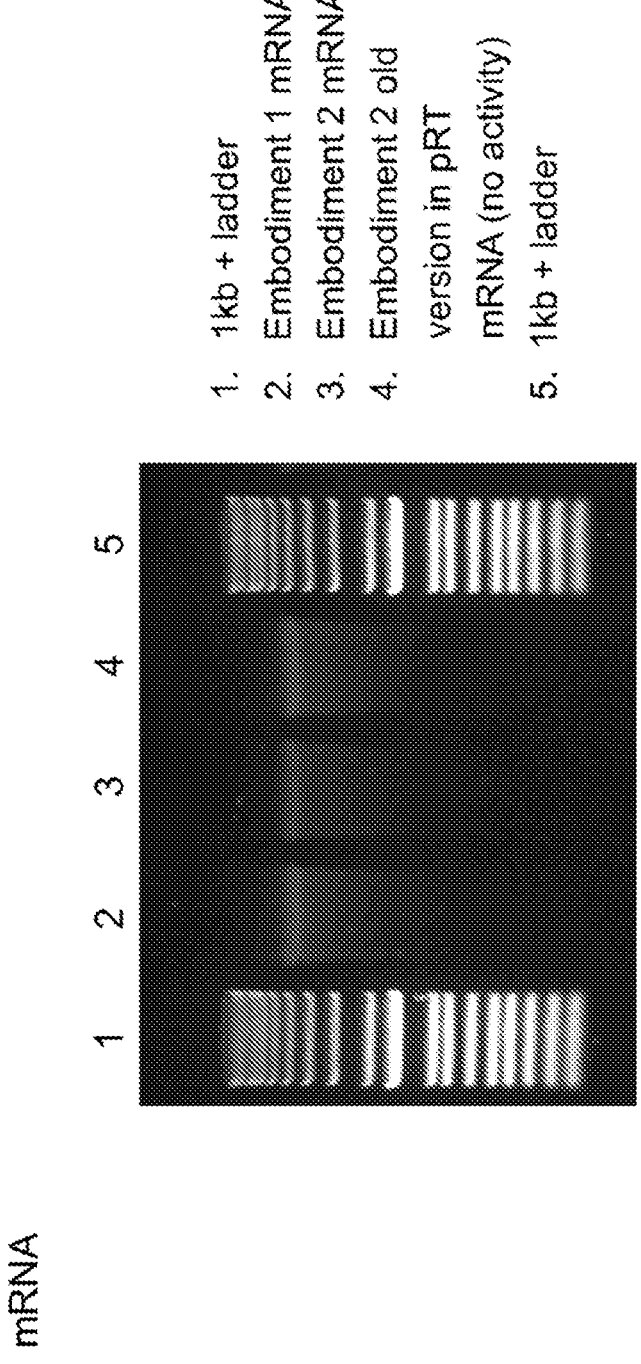
FIG. 17 is a photograph of a gel electrophoresis analysis of mRNA encoding each of Embodiment 1 (Lane 2; pRT1-Clo051-dCas9 Double NLS, as shown in FIG. 15) or Embodiment 2 (Lane 3; Csy4-T2A-Clo051-G4Slinker-dCas9, as shown in FIG. 14). In addition, a previous preparation ("old version") of mRNA encoding Embodiment 2 is included (Lane 4) for comparison. As shown, all mRNA samples encoding the two different embodiments migrate as distinct bands within the gel, are of high quality, and are similar in size, as expected.

Example 8: Enhancing Surface Expression of PD1 and TGFβRII Null or Switch Intracellular Signaling Proteins on Armored T-Cells To create armored T-cells, a number of truncated null receptors expressing alternative signal peptides (SP) and transmembrane domains (TM) were designed and tested for maximal expression on the surface of modified T-cells. FIG. 12 shows schematic diagrams of several null receptor constructs for PD-1 (top) and TGFβRII (bottom). Extracellular domains (ECD) of these proteins were modified such that the wildtype signal peptide (SP) and/or the transmembrane domains (TM) were replaced with that from the human T cell CD8α receptor (red arrows). Each of the six truncated null constructs shown in FIG. 12 were DNA synthesized and then subcloned into an mRNA IVT DNA vector (pRT). High quality mRNA was produced via IVT for each. Transfection of mRNA encoding each of the six molecules was performed using electroporation (EP) delivery into primary human T cells and FACS analysis was performed 24 hours post-EP to evaluate expression level of each construct on the cell surface (FIG. 13). By flow cytometry, replacement of the WT SP with the alternative CD8a (02.8aSP-PD-1 and 02.8aSP-TGFβRII) resulted in the highest level of expression at the T cell surface. 02.8aSP-PD-1 Null receptor exhibited an MFI of 43,680, which is 177-fold higher than endogenous T cell PD-1 expression and 2.8-fold higher than the WT PD-1 Null receptor. 02.8aSP-TGFβRII Null receptor exhibited an MFI of 13,809, which is 102-fold higher than endogenous T cell TGFβRII expression and 1.8-fold higher than the WT TGFβRII Null receptor. These results show that replacement of wildtype SP with the alternative CD8a SP for both PD1 and TGFβRII inhibitory proteins leads to enhanced surface expression of the Null or Switch receptor. This in turn will maximize checkpoint inhibition or co-stimulation, respectively, upon binding of the natural ligand (s).

INCORPORATION BY REFERENCE

Every document cited herein, including any cross referenced or related patent or application is hereby incorporated herein by reference in its entirety unless expressly excluded or otherwise limited. The citation of any document is not an admission that it is prior art with respect to any invention disclosed or claimed herein or that it alone, or in any combination with any other reference or references, teaches, suggests or discloses any such invention. Further, to the extent that any meaning or definition of a term in this document conflicts with any meaning or definition of the same term in a document incorporated by reference, the meaning or definition assigned to that term in this document shall govern.

OTHER EMBODIMENTS

While particular embodiments of the disclosure have been illustrated and described, various other changes and modifications can be made without departing from the spirit and scope of the disclosure. The scope of the appended claims includes all such changes and modifications that are within the scope of this disclosure.

SEQUENCE LISTING (17111 sequences)

SEQ ID NO: 1 - protein, 306 aa, Homo Sapiens
LTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELGPGPGSWPHGCLGLMVAKEFGQRMPKEWKAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRL

SEQ ID NO: 2 - protein, 495 aa, Homo Sapiens
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 3 - protein, 90 aa, Homo Sapiens
MGKNKLLHPSLVLLLLVLLPTDASVSGKPQYMVLVPSLLHTETTEKGCVLLSYLNETVTVSASLESVRGNRSLFTDLEAENDVLHCVAFA

SEQ ID NO: 4 - protein, 168 aa, Homo Sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQ

SEQ ID NO: 5 - protein, 1474 aa, Homo Sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 6 - protein, 73 aa, Homo Sapiens
NGGTLLGLKKLSFYYLIMAKGGIVRTGTHGLLVKQEDMKGHFSISIPVKSDIAPVARFTTCYQKRTSLASLGL

SEQ ID NO: 7 - protein, 183 aa, Homo Sapiens
MLGELIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDL

SEQ ID NO: 8 - protein, 963 aa, Homo Sapiens
MLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 9 - protein, 81 aa, Homo Sapiens
MVRNNFYAVRLLPSTCVVLSQTSNCRRSHQDPLAASCICQASGCWLIGKGSLVMEGQKHLNSKKKGLKASFSLSLTFTSRL

SEQ ID NO: 10 - protein, 1454 aa, Homo Sapiens
MWAQLLLGMLALSPAIAEELPNYLVTLPARLNFPSVQKVCLDLSPGYSDVKFTVTLETKDKTQKLLEYSGLKKRHLHCISFLVPPPAGGTEEVATIRVSGVGNNISFEEKKKVLIQRQGNGTFVQTDKPLYTPGQQVYFRIVTMDSNFVPVNDKYSMVELQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQLPDKCRNLSGQTDKTGCFSAPVDMATFDLIGYAYSHQINIVATVVEEGTGVEANATQNIYISPQMGSMTFEDTSNFYHPNFPFSGKIRVRGHDDSFLKNHLVFLVIYGTNGTFNQTLVTDNNGLAPFTLETSGWNGTDVSLEGKFQMEDLVYNPEQVPRYYQNAYLHLRPFYSTTRSFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 11 - protein, 1004 aa, Homo Sapiens
SFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 12 - protein, 182 aa, Homo Sapiens
  misc_feature (1)..(1): Xaa can be any naturally occurring amino acid
XRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 13 - protein, 340 aa, Homo Sapiens
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 14 - protein, 401 aa, Homo Sapiens
MGLKALCLGLLCVLFVSHFYTPMPDNIEESWKIMALDAIAKTCTFTAMCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICIAGDSSGGNLATAVTQQVQNDAEIKHKIKMQVLLYPGLQITDSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLLRDDGLMYVTRLRNVGVQVVHEHIEDGIHGALSFMTSPFYLRLGLRIRDMYVSWLDKNL

SEQ ID NO: 15 - protein, 53 aa, Homo Sapiens
MGLKALCLGLLCVLFVSHFYTPMPDNIEESWKIMALDAIAKTCTFTNRGLLTS

SEQ ID NO: 16 - protein, 252 aa, Homo Sapiens
MEPQSMKGQKRPFGGPWRLKVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 17 - protein, 152 aa, Homo Sapiens [sequence omitted]

SEQ ID NO: 18 - protein, 207 aa, Homo Sapiens
MSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 19 - protein, 92 aa, Homo Sapiens
MSTQSTHPLKPEAPRLPPGIPESPSCQRRHTLPASEFRCLTPEDAVSAFEIEREDSGREAQRLPVTHLSLLPQPSSPSWASAPCTWMRSGTS

SEQ ID NO: 20 - protein, 257 aa, Homo Sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVKEILTALGLLSCANTRTGSLSGGQRKRLAIALELVNNPPVMFFDEPTSGLDSASCFQVVSLMKGLAQGGRSIICTIH

SEQ ID NO: 21 - protein, 678 aa, Homo Sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 22 - protein, 666 aa, Homo Sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 23 - protein, 663 aa, Homo Sapiens
MIMRLPQPHGTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 24 - protein, 824 aa, Homo Sapiens
MLAVQQTEHLPACPPARRWSSNFCPESTEGGPSLLGLRDMVRRGWSVCTAILLARLWCLVPTHTFLSEYPEAAEYPHPGWVYWLQMAVAPGHLRAWVMRNNVTTNIPSAFSGTLTHEEKAVLTVFTGTATAVHVQVAALASAKLESSVFVTDCVSCKIENVCDSALQGKRVPMSGLQGSSIVIMPPSNRPLASAASCTWSVQVQGGPHHLGVVAISGKVLSAAHGAGRAYGWGFPGDPMEEGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 25 - protein, 668 aa, Homo Sapiens
MLGTQGWTKQRKPCPQNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 26 - protein, 677 aa, Homo Sapiens
MRISLPRAPERDGGVSASSLLDTVTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 27 - protein, 177 aa, Homo Sapiens
MAPGQTPSLCSWLLPLPSTWATTGHVCFSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRS

SEQ ID NO: 28 - protein, 102 aa, Homo Sapiens
MAPGQTPSLCSWLLPLPSTWATTGHVCFSDILQTPDGGQLLLDWAKQPDSSQDPDPTTQPIVLLLPGITGSSQETYVLHLVNQALRDGYQPTGLFVPAILKI

SEQ ID NO: 29 - protein, 405 aa, Homo Sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 30 - protein, 305 aa, Homo Sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERLSYGKTCRPVQSASLMSATHLWPLDIKTVLPTTKQQALEPR

SEQ ID NO: 31 - protein, 305 aa, Homo Sapiens; identical to SEQ ID NO: 30

SEQ ID NO: 32 - protein, 205 aa, Homo Sapiens
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVEDSGRKNYISLHSA

SEQ ID NO: 33 - protein, 306 aa, Homo Sapiens
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 34 - protein, 52 aa, Homo Sapiens
MAVARLAAVAAWVPCRSWGWAAVPFGPHRGLSVLLARIPQRAPRWLPDSCWI

SEQ ID NO: 35 - protein, 75 aa, Homo Sapiens
MAVARLAAVAAWVPCRSWGWAAVPFGPHRGLSVLLARIPQRAPRWLPGLITQELEVQMVTQRKAHWGNGEKMFFL

SEQ ID NO: 36 - protein, 229 aa, Homo Sapiens [sequence omitted]

SEQ ID NO: 37 - protein, 225 aa, Homo Sapiens [sequence omitted]

SEQ ID NO: 38 - protein, 153 aa, Homo Sapiens [sequence omitted]

SEQ ID NO: 39 - protein, 124 aa, Homo Sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRLQPLSCMESWTTSWLESHCGSSATCPTTLW

SEQ ID NO: 40 - protein, 271 aa, Homo Sapiens
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 41 - protein, 468 aa, Homo Sapiens
MPPWGAALALILAVLALLGLLGPRLRGPWGRAVGERTLPGAQDRDDGEEADGGGPADQFSDGREPLPGGCSLVCKPSALAQCLLRALRRSEALEAGPRSWFSGPHLQTLCHFVLPVAPGPELAREYLQLADDGLVALDWVVGPCVRGRRITSAGGLPAVLLVIPNAWGRLTRNVLGLCLLALERGYYPVIFHRRGHHGCPLVSPRLQPFGDPSDLKEAVTYIRFRHPAAPLFAVSEGSGSALLLSYLGECGSSSYVTGAACISPVLRCREWFEAGLPWPYERGFLLHQKIALSRYATALEDTVDTSRLFRSRSLREFEEALFCHTKSFPISWDTYWDRNDPLRDVDEAAVPVLCICSADDPVCGPPDHTLTTELFHSNPYFFLLLSRHGGHCGFLRQEPLPAWSHEVILESFRALTEFFRTEERIKGLSRHRASFLGGRRRGGALQRREVSSSSNLEEIFNWKRSYTR

SEQ ID NO: 42 - protein, 191 aa, Homo Sapiens
CIVVLWYGWLHFYAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKA

SEQ ID NO: 43 - protein, 60 aa, Homo Sapiens
MRGGKCNMLSSLGCLLLCGSITLALGNAQKLPKANKRTELVIQHGWMSLIKMMLNERSQV

SEQ ID NO: 44 - protein, 161 aa, Homo Sapiens
MRGGKCNMLSSLGCLLLCGSITLALGNAQKLPKDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVG

SEQ ID NO: 45 - protein, 1075 aa, Homo Sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 46 - protein, 1777 aa, Homo Sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 47 - protein, 1005 aa, Homo Sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSGKCMNPWLK

SEQ ID NO: 48 - protein, 188 aa, Homo Sapiens [sequence omitted]

SEQ ID NO: 49 - protein, 233 aa, Homo Sapiens
QRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVK

SEQ ID NO: 50 - protein, 158 aa, Homo Sapiens
VSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPLETRGIPFIPMISPSPSQEELQTTL

SEQ ID NO: 51 - protein, 84 aa, Homo Sapiens
  misc_feature (1)..(1): Xaa can be any naturally occurring amino acid
XFEKPRGTLASSEKPWIVPTAKISEDSKVLQPQTATSDRILDSIPPKTSRTLEQPRATLAPSETPFVPQKLEIFTSPEMQPTTP

SEQ ID NO: 52 - protein, 187 aa, Homo Sapiens
  misc_feature (1)..(1): Xaa can be any naturally occurring amino acid
XFISLKPKIPLSPEVTHTKPAPKTSQRTRTRRPRPKHKTTPRPETLQTKLDFGPITPGTSSAPTTTTKRTRRPHPKPKTTPHPEVPQTKLAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTL

SEQ ID NO: 53 - protein, 1131 aa, Homo Sapiens
  misc_feature (1)..(1): Xaa can be any naturally occurring amino acid
XISLKPKIPLSPEVTHTKPAPEPQTLLPSQSTIGPETPGTKPSTTLALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 54 - protein, 125 aa, Homo Sapiens
  misc_feature (1)..(1): Xaa can be any naturally occurring amino acid
XKNETLALPAESKTPEVEKISARPTTVTPETVPRSTKPTTSSALDVSETTLAPKSLPEFPEAKTPFPFEKPRGTLASSEKPWIVPTAKISEDSKVLQPQTALTELQTLILKPVTSPSLEMTESQP

SEQ ID NO: 55 - protein, 187 aa, Homo Sapiens
  misc_feature (1)..(1): Xaa can be any naturally occurring amino acid
XKTTPHPEVPQTKLAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPAPKQTPRAPPKPKTSPRPRIPQTQPVPKVPQRVTAKPKTSPSPEVSYTTPAPLETRGIPFIPMISPSPSQEELQTTL

SEQ ID NO: 56 - protein, 187 aa, Homo Sapiens
  misc_feature (1)..(1): Xaa can be any naturally occurring amino acid
XNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQT

SEQ ID NO: 57 - protein, 150 aa, Homo Sapiens
  misc_feature (1)..(1): Xaa can be any naturally occurring amino acid
XPETPGTKPSTTLAPRKTKRPGRRPRPRPRPKTTPSPEVPKSKPALEPATIQPEPLVPTTVPTTDIEPVTVRTEATVTTLAPKTSQRTRTRRPRPKHKTTPRPETLQTKLDFGPITPGTSSAPTTTTKRTRRPHPKPKTTPHPEVPQTKL

SEQ ID NO: 58 - protein, 308 aa, Homo Sapiens
  misc_feature (1)..(1): Xaa can be any naturally occurring amino acid
XPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPG

SEQ ID NO: 59 - protein, 87 aa, Homo Sapiens
  misc_feature (1)..(1): Xaa can be any naturally occurring amino acid
XQTLLPSQSTIGPETPGTKPSTTLAPRKTKRPGRRPRPRPRPKTTPSPEVPKSKPALEPATIQPEPLVPTTVSEPVPFETEAPSMTI

SEQ ID NO: 60 - protein, 187 aa, Homo Sapiens
  misc_feature (1)..(1): Xaa can be any naturally occurring amino acid
XRTTSAGTITPKISKSPEPTWTTPAPGKTQFISLKPKIPLSPEVTHTKPVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKVPQRTHRPHPKPKTTLSPEELQTELVPATIFEPVSPIKEAPGTTF

SEQ ID NO: 61 - protein, 189 aa, Homo Sapiens
  misc_feature (1)..(1): Xaa can be any naturally occurring amino acid
XTAKPKTSPSPEVSYTTPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRS

SEQ ID NO: 62 - protein, 303 aa, Homo Sapiens
  misc_feature (1)..(1): Xaa can be any naturally occurring amino acid
XTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQI

SEQ ID NO: 63 - protein, 151 aa, Homo Sapiens
  misc_feature (1)..(1): Xaa can be any naturally occurring amino acid
XVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPVLQPVTFRFEPPKTTIAPLETRGIPFIPMISPSPSQEELQTTL

SEQ ID NO: 64 - protein, 198 aa, Homo Sapiens
LLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKLYSFSECHLHPGSRLKEQPLFGTCPHGIRQRARKLVDYRREPPQLAHELIFQFISVYFQRTNWHDKSCINEKLHVKKHFTTYKAYL

SEQ ID NO: 65 - protein, 360 aa, Homo Sapiens
MDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 66 - protein, 74 aa, Homo Sapiens
MEGESTSAVLSGFVLGALAFQHLNTDSDTEGFLLGEVKGEAKNSITDSQMDDVEVVYTIDIQKYIPCYQLFRMW

SEQ ID NO: 67 - protein, 409 aa, Homo Sapiens
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 68 - protein, 37 aa, Homo Sapiens
MEGESTSAVLSGFVLGALAFQHLNTDSDTVGRGGSRL

SEQ ID NO: 69 - protein, 189 aa, Homo Sapiens
MEGESTSAVLSGFVLGALAFQHLNTDSDTVSRGTGRGPASPGKSPARGLPPRCCSGPRPLPRRRRASSLRSRLCLLSPSAVPEEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLL

SEQ ID NO: 70 - protein, 220 aa, Homo Sapiens
MKTSSPKENCLFLCFTSMKNGQEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELK

SEQ ID NO: 71 - protein, 82 aa, Homo Sapiens
MMLKLFIQLMESHSVAQTGVKWHDLGSLQPLPLEVKRFSCLGLRSSWDYRHTQPCPANFFCIFSRDGVSPCWPGWSRTPDLK

SEQ ID NO: 72 - protein, 536 aa, Homo Sapiens
MGAWAFPAALFLLCLTSESLQGGLPLLPPGLGKVYGPHSGLGAGYDGGVKPQKPGFVVRHGLGTQPDTEGGMKPQNLGFRTFAGAAAQPGYGNGLGAAAFPVAGAQSGPAAQNGFGPGFGGGGKPQKPGPTTQNGYRPGYVGAVKPQKPGFQYRIGLGAQPGFRGDMKAQEPGLGNGNGLSAQPVLTAQNRFGFGAGLGGNVKPLKPGYGKRLRAGAFPGAGTQPEYGHGNGPGVQPGLGAGMKPQMPGLGAPNGYGPGRGRAGVPGGPERRPWVPHLLPFSSPGYLGVMKAQKPGPLAQNGYRAGAGEGMKPQKPGLRGTLKPQKSGHGHENGPWPGPCNARVAPMLLPRLPTPGVPSDKEGGWGLKSQPPSAVQNGKLPAPMPAIQWGLKPQKAGHQPPNGYGPGAEPGFNGGLEPQKIGLGYGNGVLGARVFPEAHPQPGFHGANGFRNRDGVEALVYPKAAALAPEGNGQAGVLWNSRWPTLQAWGAGLKPGYQAGDEYAEARSQPGGPDVKRGSNGQLGNGYGGRCPLGKC

SEQ ID NO: 73 - protein, 195 aa, Homo Sapiens
MPNFLGLHRARSFTVLCFWSTADVLNASGPRRQWHPLASCSSWSRPQSQGSTPGVLCKTGMGREPIPETQCHFANSMCSLHVSVPYFGNSPNISNFFRWSLALSPRQWCDLGSLQPPSPRFKGFSCLSLPSSWDYRRAPSPANFCILVEMGFHHVGQADLELLTSADLPTSASQSAGITGVSHHAWPQTLSLLLY

SEQ ID NO: 74 - protein, 130 aa, Homo Sapiens
MGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAP

SEQ ID NO: 75 - protein, 77 aa, Homo Sapiens
MSKGLLLLLLLSMGGTWASKEPLRPRCRPINATLAVEKEGCPVCITVNTTICAGYCPTMTRVLQGVLPALPQVVCNY

SEQ ID NO: 76 - protein, 165 aa, Homo Sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLG

SEQ ID NO: 77 - protein, 210 aa, Homo Sapiens [sequence omitted]

SEQ ID NO: 78 - protein, 83 aa, Homo Sapiens [sequence omitted]

SEQ ID NO: 79 - protein, 105 aa, Homo Sapiens
MKGWGWLALLLGALLGTAWARRSQDLHCGACRALVDELEWEIAQVDPKKTIQMGSFRINPDGSQSVVENASCLVLAARHASASSTNLKDILADLIPKEQARIKTF

SEQ ID NO: 80 - protein, 263 aa, Homo Sapiens
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDGGTSKNRDRKGKMDVTNSAEKSRRSPAMALLTAAARLLGTKNASCLVLAARHASASSTNLKDILADLIPKEQARIKTFRQQHGKTVVGQITVDM

SEQ ID NO: 81 - protein, 171 aa, Homo Sapiens
MPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIAKSPKCPVRTRI

SEQ ID NO: 82 - protein, 123 aa, Homo Sapiens
  misc_feature (1)..(1): Xaa can be any naturally occurring amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIAKSPKCPVRTRI

SEQ ID NO: 83 - protein, 117 aa, Homo Sapiens
  misc_feature (1)..(1): Xaa can be any naturally occurring amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIDNEEIF

SEQ ID NO: 84 - protein, 153 aa, Homo Sapiens
  misc_feature (1)..(1): Xaa can be any naturally occurring amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIEEETVTQKCRVLPKVIQVNRTHHSLLMRRNLTKLFQFARGTF

SEQ ID NO: 85 - protein, 104 aa, Homo Sapiens
MGSTWGSPGWVRLALCLTGLVLSLYALHVKAARARDRDYRALCDVGTAISCSRVFSSRAAATELNSWSVVLGSLQREGLSPGAEEVGVAALQLPRAYNHYSQGS

SEQ ID NO: 86 - protein, 166 aa, Homo Sapiens
MGSTWGSPGWVRLALCLTGLVLSLYALHVKAARARDRDYRALCDVGTAISCSRVFSSRWGRGFGLVEHVLGQDSILNQSNSIFGCIFYTLQLLLGLQAAQRACGQRGPGPPKPQEGNTVPGEWPWQASVRRQGAHICSGSLVADTWVLTAAHCFEKAAATELNSWS

SEQ ID NO: 87 - protein, 121 aa, Homo Sapiens
  misc_feature (1)..(1): Xaa can be any naturally occurring amino acid
XDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 88 - protein, 199 aa, Homo Sapiens
MALLLRFVLLCRVADFIRGWSITTPEQMIEKAKGETAYLPCKFTLSPEDQGPLDIEWLISPADNQKVDQVIILYSGDKIYDDYYPDLKGRVHFKSNDLKSGDASINVTNFQLSDIGTDQCKVKRAPGVANRKIQLVVLGKMCRLQRAARPLPEATAVIIHPWDPYLLPTWKDIPRLSINKYQVKTLNALLRVRLSHLLR

SEQ ID NO: 89 - protein, 116 aa, Homo Sapiens
MEFGLNWVFLVAIIKGAQCEVQLVESGGGLVQPGGSLRLSCPDSGFTFSNHYMSWVRQAPGKGLEWISYISGDSGYTNYADSVKGRFTISRDNANNSPYLQMNSLRAEDTAVYYCV

SEQ ID NO: 90 - protein, 124 aa, Homo Sapiens
MLCPRAAFLVGSFHGVFPGPPASSHWEFWVPSTPVGAYFCPPQPQLTPPNTPKLVSEVEELYKSITALREKLLQAEQSLRNLKDIHMSLEKDVTAMTNSVFIDRQKCMAHRTCYPTILQLAGYQ

SEQ ID NO: 91 - protein, 117 aa, Homo Sapiens
MKHLWFFLLLVAAPRWVLSQVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCAR

SEQ ID NO: 92 - protein, 67 aa, Homo Sapiens
MESPSAPPHRWCIPWQRLLLTASLLTFWNPPTTAKLTIESTPFNVAEGKEVLLLAHNLPQNRIGYSW

SEQ ID NO: 93 - protein, 152 aa, Homo Sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSN

SEQ ID NO: 94 - protein, 155 aa, Homo Sapiens
MSPAKCKICFPDREVKPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASEN

SEQ ID NO: 95 - protein, 143 aa, Homo Sapiens
MTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILG

SEQ ID NO: 96 - protein, 858 aa, Homo Sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKGCLGTWRDVSWWKIRAMLPMHIGEGSV

SEQ ID NO: 97 - protein, 2458 aa, Homo Sapiens
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 98 - protein, 2458 aa, Homo Sapiens; identical to SEQ ID NO: 97

SEQ ID NO: 99 - protein, 859 aa, Homo Sapiens
  misc_feature (1)..(1): Xaa can be any naturally occurring amino acid
XMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKGCLGTWRDVSWWKIRAMLPMHIGEGSV

SEQ ID NO: 100 - protein, 112 aa, Homo Sapiens
  misc_feature (1)..(1): Xaa can be any naturally occurring amino acid
XVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKIHDHGYHREG

SEQ ID NO: 101 - protein, 2431 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 102 - protein, 2530 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 103 - protein, 2492 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 104 - protein, 721 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGMQPHFGSNSPFCLERTPLGSPDPATTQYPIHQSKKMSVPLGQSQL

SEQ ID NO: 105 - protein, 2530 aa, Homo Sapiens; identical to SEQ ID NO: 102

SEQ ID NO: 106 - protein, 2568 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDIDECLSSPCLNGATCVDAIDSFTCLCLPSYEGDLCEIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 107 - protein, 2473 aa, Homo Sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 108 - protein, 156 aa, Homo Sapiens
  misc_feature (1)..(1): Xaa can be any naturally occurring amino acid
XWNDVPCNYHLPFTCKKGTVACGEPPVVEHARTFGQKKDRYEINSLVRYQCTEGFVQRHMPTIRCQPSGHWEEPQITCTDREHHPGHLAEHRPPPTNADYRSGAHGTLGGAAPAQPTEKSFQDAPRTLSPGACQADVHPTQTVSSSCRFLSYKESH

SEQ ID NO: 109 - protein, 282 aa, Homo Sapiens
LDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNEHDINFLMKMALDKIAFIPFSYLVDQWRWRVFDGSITKENYNQEWWSLRLKYQGLCPPVP

SEQ ID NO: 110 - protein, 314 aa, Homo Sapiens
MDEGGCSQAAPAFAEGAGLGSGAPALSGSCLLTSGRCRCHRHRTALSIHPPLARPLFWSQFLLHHSHEADSLQKEEARLPQTKEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQ

SEQ ID NO: 111 - protein, 168 aa, Homo Sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQISPTSWLPREATPCSCLPGRAGTTLRASR

SEQ ID NO: 112 - protein, 1306 aa, Homo Sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 113 - protein, 1242 aa, Homo Sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 114 - protein, 36 aa, Homo Sapiens
MGQGWATAGLPSLLFLLLCYGHPLLVPSQEASQQTW

SEQ ID NO: 115 - protein, 36 aa, Homo Sapiens; identical to SEQ ID NO: 114

SEQ ID NO: 116 - protein, 145 aa, Homo Sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILGLYDTWGSSLLCPCLDMCCLTAGIQGGCRRTCK

SEQ ID NO: 117 - protein, 208 aa, Homo Sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPALKFSELPLQAEVS

SEQ ID NO: 118 - protein, 732 aa, Homo Sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 119 - protein, 691 aa, Homo Sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRTAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 120 - protein, 119 aa, Homo Sapiens
  misc_feature (1)..(1): Xaa can be any naturally occurring amino acid
XQAGSSRPWQEVLKDMVGLDALDAQPLLKYFQPVTQWLQEQNQQNGEVLGWPEYQWHPPLPDNYPEGIGDSHPWDKQPGNNQQPDNHPPGDGPPDISPEPKWDHAGEGQGARGGRGGAG

SEQ ID NO: 121 - protein, 138 aa, Homo Sapiens
  misc_feature (1)..(1): Xaa can be any naturally occurring amino acid
XRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 122 - protein, 94 aa, Homo Sapiens
MLGLVMSCPDRTLVTKVRSHPSGNQHRPTRGGSRSFHCRRGVRPRPAALRVLPRCPAFSDAACPAAMRPPQCLLHTPSLASPLLLLLLWLLGGG

SEQ ID NO: 123 - protein, 55 aa, Homo Sapiens
MRPPQCLLHTPSLASPLLLLLLWLLGGGVGAEGREDAELLVTVLRAPRCGTPTVS

SEQ ID NO: 124 - protein, 159 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGAS

SEQ ID NO: 125 - protein, 614 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 126 - protein, 617 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHLRRL

SEQ ID NO: 127 - protein, 614 aa, Homo Sapiens; identical to SEQ ID NO: 125

SEQ ID NO: 128 - protein, 614 aa, Homo Sapiens; identical to SEQ ID NO: 125

SEQ ID NO: 129 - protein, 617 aa, Homo Sapiens; identical to SEQ ID NO: 126

SEQ ID NO: 130 - protein, 435 aa, Homo Sapiens [sequence omitted]

SEQ ID NO: 131 - protein, 398 aa, Homo Sapiens [sequence omitted]

SEQ ID NO: 132 - protein, 526 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 133 - protein, 359 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQGSQ

SEQ ID NO: 134 - protein, 403 aa, Homo Sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQGSQ

SEQ ID NO: 135 - protein, 391 aa, Homo Sapiens
MAGKRSGWSRAALLQLLLGVNLVVMPPTRARSLRFVTLEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 136 - protein, 151 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRD

SEQ ID NO: 137 - protein, 423 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 138 - protein, 162 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQAQVTRTVEHSA

SEQ ID NO: 139 - protein, 305 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPW

SEQ ID NO: 140 - protein, 360 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 141 - protein, 160 aa, Homo Sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRSRTETLIHFS

SEQ ID NO: 142 - protein, 395 aa, Homo Sapiens
MGVRMTEYVGLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 143 - protein, 6 aa, Homo Sapiens
MDMWTA

SEQ ID NO: 144 - protein, 52 aa, Homo Sapiens
MDMWTALLILQALLLPSLADGATPALRFVAVGDWGGVPNAPFHTAREMANAK

SEQ ID NO: 145 - protein, 74 aa, Homo Sapiens
MDMWTALLILQALLLPSLADGATPALRFVAVGDWGGVPNAPFHTAREMANAKEIARTVQILGADFILSLGDNFY

SEQ ID NO: 146 - protein, 124 aa, Homo Sapiens
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYS

SEQ ID NO: 147 - protein, 325 aa, Homo Sapiens
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 148 - protein, 325 aa, Homo Sapiens; identical to SEQ ID NO: 147

SEQ ID NO: 149 - protein, 325 aa, Homo Sapiens; identical to SEQ ID NO: 147

SEQ ID NO: 150 - protein, 325 aa, Homo Sapiens; identical to SEQ ID NO: 147

SEQ ID NO: 151 - protein, 59 aa, Homo Sapiens
MDMWTALLILQALLLPSLGISWTPQSGTSARSPTAICASTMGLKTHWVALPMWRSAPKR

SEQ ID NO: 152 - protein, 228 aa, Homo Sapiens
MITGVFSMRLWTPVGVLTSLAYCLHQRRVALAELQEADGQCPVDRSLLKLKMVQVVFRHGARSPLKPLPLEEQGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 153 - protein, 428 aa, Homo Sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 154 - protein, 271 aa, Homo Sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 155 - protein, 77 aa, Homo Sapiens
MITGVFSMRLWTPVGVLTSLAYCLHQRRVALAELQEADGQCPVDRSLLKLKMVQVVFRHGARSPLKPLPLEEQYSFH

SEQ ID NO: 156 - protein, 143 aa, Homo Sapiens
MVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTD

SEQ ID NO: 157 - protein, 166 aa, Homo Sapiens
  misc_feature (1)..(1): Xaa can be any naturally occurring amino acid
XDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQEKMGSCRFHGS

SEQ ID NO: 158 - protein, 157 aa, Homo Sapiens
  misc_feature (1)..(1): Xaa can be any naturally occurring amino acid
XRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRTCR

SEQ ID NO: 159 - protein, 334 aa, Homo Sapiens
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVATSLTTRLASACRGIMRACGTAGIWVPPTSSPSPPRSISFSIMAATWYRGSFAGWRATSRKPIRTGQPGRGSSLWGTGPCTAPTQIWTTAHDMKARSAKASKASCTGWRIFSTNMEWICSCGLMSTRMNDCGQFTTTRYLTAAERCPTPTREGLSTSSQDLLMGRS

SEQ ID NO: 160 - protein, 367 aa, Homo Sapiens
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVATSLTTRLASACRGIMRACGTGNVGVLGDWPSPLKDGRCRGALVPDPCPLTPPAGIWVPPTSSPSPPRSISFSIMAATWYRGSFAGWRATSRKPIRTGQPGRGSSLWGTGPCTAPTQIWTTAHDMKARSAKASKASCTGWRIFSTNMEWICSCGLMSTRMNDCGQFTTTRYLTAAERCPTPTREGLSTSSQDLLAVRSG

SEQ ID NO: 161 - protein, 438 aa, Homo Sapiens
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVGDFAYNLDQDNARVGDRFMRLIEPVAASLPYMTCPGNHEERYNFSNYKARFSMPGDNEGLWYSWDLGPAHIISFSTEVYFFLHYGRHLVQRQFRWLESDLQKANKNRAARPWIITMGHRPMYCSNADLDDCTRHESKVRKGLQGKLYGLEDLFYKYGVDLQLWAHEHSYERLWPIYNYQVFNGSREMPYTNPRGPVHIITGSAGCEERLTPFAVFPRPWSAVRVKEYGYTRLHILNGTHIHIQQVSDDQDGKIVDDVWVVRPLFGRRMYL

SEQ ID NO: 162 - protein, 227 aa, Homo Sapiens
  misc_feature (1)..(1): Xaa can be any naturally occurring amino acid
XGADNPKAVPRLRRDTQQGMYDAVLHVGDFAYNLDQDNARVGDRFMRLIEPVAASLPYMTCPGNHEERYNFSNYKARFSMPGDNEGLWYSWDLGPAHIISFSTEVYFFLHYGRHLVQRQFRWLESDLQKANKNRAARPWIITMGHRPMYCSNADLDDCTRHESKVRKGLQGKLYGLEDLFYKYGVDLQLWAHEHSYERLWPIYNYQDGKIVDDVWVVRPLFGRRMYL

SEQ ID NO: 163 - protein, 353 aa, Homo Sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 164 - protein, 418 aa, Homo Sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 165 - protein, 386 aa, Homo Sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 166 - protein, 165 aa, Homo Sapiens
MRAAPLLLARAASLSLGFLFLLFFWLDRSVLAKELKFVTLVFRHGDRSPIDTFPTDPIKESSWPQGFGQLTQVYIRSTDVDRTLMSAMTNLAALFPPEGVSIWNPILLWQPIPVHTVPLSEDQLLYLPFRNCPRFQELESETLKSEEFQKRLHPYKDFIATLGKL

SEQ ID NO: 167 - protein, 99 aa, Homo Sapiens
  misc_feature (1)..(1): Xaa can be any naturally occurring amino acid
XELYFEKGEYFVEMYYRNETQHEPYPLMLPGCSPSCPLERFAELVGPVIPQDWSTECMTTNSHQGPAETAHSARRNHDIALPCGRSTCLENTVLYYHYG

SEQ ID NO: 168 - protein, 421 aa, Homo Sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 169 - protein, 212 aa, Homo Sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKGFLECPAGTSPFKTGVAVALELCP

SEQ ID NO: 170 - protein, 100 aa, Homo Sapiens
MRKPAAGFLPSLLKVLLLPLAPAAAQDSTQASTPGSPLSPTEYERFFALLTPTWKAETTCRLRATHGCRNPTLVQLDQYENHGLVPDESPVFPASLYSLT

SEQ ID NO: 171 - protein, 510 aa, Homo Sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 172 - protein, 174 aa, Homo Sapiens [sequence omitted]

SEQ ID NO: 173 - protein, 543 aa, Homo Sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 174 - protein, 319 aa, Homo Sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGRYRKF

SEQ ID NO: 175 - protein, 265 aa, Homo Sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 176 - protein, 246 aa, Homo Sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGTILNCYTCAYMNDQGKCLRGEGTCITQNSQQCMLKKIFEGGKLQFMVQGCENMCPSMNLFSHGTRMQIICCRNQSFCNKI

SEQ ID NO: 177 - protein, 210 aa, Homo Sapiens
MNRFLLLMSLYLLGSARGTSSQPNELSGSIDHQTSVQQLPGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 178 - protein, 195 aa, Homo Sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 179 - protein, 45 aa, Homo Sapiens
MAVYVGMLRLGRLCAGSSGVLGARAALSRSWQEARLQGVRFLRCL

SEQ ID NO: 180 - protein, 54 aa, Homo Sapiens
MAVYVGMLRLGRLCAGSSGVLGARAALSRSWQEARLQGVRFLRPSGEKLAHQGV

SEQ ID NO: 181 - protein, 640 aa, Homo Sapiens
MAVYVGMLRLGRLCAGSSGVLGARAALSRSWQEARLQGVRFLSARGGMEAGRQRISVPSSFTASAAAHSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 182 - protein, 615 aa, Homo Sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 183 - protein, 602 aa, Homo Sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 184 - protein, 183 aa, Homo Sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGVCEPSLPGYGTGVCPQEGGLQGPCVPQAIQDPAILQRPEADLSRSGECPARGLEESEAP

SEQ ID NO: 185 - protein, 572 aa, Homo Sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 186 - protein, 85 aa, Homo Sapiens
TVPPSSWPLPSSMARRHWRPSAERGVIAGSPAPPELIRAIINKINMKDLVKSQEEIAAWEDGQQSTDVLLERPGRLLMEPQRTVP

SEQ ID NO: 187 - protein, 104 aa, Homo Sapiens
  misc_feature (1)..(1): Xaa can be any naturally occurring amino acid
XGKKALEAISRERGTFLYGTPTMFVDILNQPDFSSYDISTMCGGVIAGSPAPPELIRAIINKINMKDLVKSQEEIAAWEDGQQSTDVLLERPGRLLMEPQRTVP

SEQ ID NO: 188 - protein, 245 aa, Homo Sapiens
MASTALLALCSTGAFSGLAVEAGAGVCHATPIYAGHSWHQATFRLNVAGSTLSRYLRDLLVAANPDLLQQALPRKAITHLKKRSCYVSLDFEGDLRDPARHHPASFSVGNGCCVCLSSERFRCPEPIFQPGLLGQAEQGLPALAFRALQKMPKTLRTRLADTVVLAGGSTLFPGFAERLDKELEAQCRRHGYAALRPHLVAKHGRGMAVWTGGSMVASLHSFQRRWITRAMYQECGSRLLYDVFN

SEQ ID NO: 189 - protein, 21 aa, Homo Sapiens
MVDGVMILPVLIMIALPSPSM

SEQ ID NO: 190 - protein, 71 aa, Homo Sapiens
MVDGVMILPVLIMIALPSPSMEDEKPKVNPKLYMCVCEGLSCGNEDHCEGQQCFSSLSINDGFHVYQKGCF

SEQ ID NO: 191 - protein, 73 aa, Homo Sapiens
MVDGVMILPVLIMIALPSPSMEDEKPKVNPKLYMCVCEGLSCGNEDHCEGQQCFSSLSINDGFHVYQKGCFQV

SEQ ID NO: 192 - protein, 87 aa, Homo Sapiens
MVDGVMILPVLIMIALPSPSMEDEKPKVNPKLYMCVCEGLSCGNEDHCEGQQCFSSLSINDGFHVYQKGCFQVYEQGKMTCKTPPSP

SEQ ID NO: 193 - protein, 87 aa, Homo Sapiens; identical to SEQ ID NO: 192

SEQ ID NO: 194 - protein, 509 aa, Homo Sapiens
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 195 - protein, 509 aa, Homo Sapiens; identical to SEQ ID NO: 194

SEQ ID NO: 196 - protein, 509 aa, Homo Sapiens; identical to SEQ ID NO: 194

SEQ ID NO: 197 - protein, 509 aa, Homo Sapiens; identical to SEQ ID NO: 194

SEQ ID NO: 198 - protein, 443 aa, Homo Sapiens
MLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 199 - protein, 493 aa, Homo Sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 200 - protein, 336 aa, Homo Sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 201 - protein, 413 aa, Homo Sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 202 - protein, 517 aa, Homo Sapiens
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 203 - protein, 159 aa, Homo Sapiens
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEGKGRYGEVWRGLWHGESVAVKIFSSRDEQSWFRETEIYNTV

SEQ ID NO: 204 - protein, 329 aa, Homo Sapiens
MALTPPLLLLSAGTMTLGSPRKGLLMLLMALVTQGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 205 - protein, 89 aa, Homo Sapiens
MTLGSPRKGLLMLLMALVTQGDPVKPSRGPLVTCTCESPHCKGPTCRGAWCTVVLVREEGRHPQEHRGCGNLHRELCRGRPTEFVNHYC

SEQ ID NO: 206 - protein, 503 aa, Homo Sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 207 - protein, 163 aa, Homo Sapiens
  misc_feature (1)..(1): Xaa can be any naturally occurring amino acid
XSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVRPLLGLGWRGVVAHGWDFWAQELVSEASASSHRY

SEQ ID NO: 208 - protein, 99 aa, Homo Sapiens
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 209 - protein, 99 aa, Homo Sapiens; identical to SEQ ID NO: 208

SEQ ID NO: 210 - protein, 55 aa, Homo Sapiens
MAEGNTLISVDYEIFGKVQGVFFRKHTQEMTVENRIAETHSKSCVPVSFATSYAG

SEQ ID NO: 211 - protein, 62 aa, Homo Sapiens
MAEGNTLISVDYEIFGKVQGVFFRKHTQEMTVENRIAETHSKSCVPVSFATSYAGINEFKRI

SEQ ID NO: 212 - protein, 37 aa, Homo Sapiens
MAEGNTLISVDYEIFGKVQGVFFRKHTQVCGLQALGW

SEQ ID NO: 213 - protein, 129 aa, Homo Sapiens
MPASARLAGAGLLLAFLRALGCAGRAPGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 214 - protein, 97 aa, Homo Sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMLECSGLI

SEQ ID NO: 215 - protein, 98 aa, Homo Sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMNSSAPEAG

SEQ ID NO: 216 - protein, 40 aa, Homo Sapiens
MLLTQSLFGGLFPRTRETMRREAVPDDNELPRNKHLNWKS

SEQ ID NO: 217 - protein, 116 aa, Homo Sapiens
MLLTQSLFGGLFPRTRETMRRYKVSLFYLGCSRTPNVKLSSCLGLPCCWDYSYKFIQLSEFGFGQVIIVSEEPWKENISCSSTTFIKSTICLNPDSEFRPCFNAWLSLIRENAVGL

SEQ ID NO: 218 - protein, 172 aa, Homo Sapiens
MLLTQSLFGGLFPRTRETMRRYKVSLFYLGCSRTPNVKLSSCLGLPCCWDYSYKFIQLSEFGFGQVIIVSEEPWKENISCSSTTFIKSTICLSVCFRMYTEDEARKIGVVGWVKNTSKGTVTGQVQGPEDKVNSMKSWLSKVGSPSSRIDRTNFSNEKTISKLEYSNFSIRY

SEQ ID NO: 219 - protein, 99 aa, Homo Sapiens
MSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 220 - protein, 83 aa, Homo Sapiens
MTALVLQIEYTEDEARKIGVVGWVKNTSKGTVTGQVQGPEDKVNSMKSWLSKVGSPSSRIDRTNFSNEKTISKLEYSNFSIRY

SEQ ID NO: 221 - protein, 66 aa, Homo Sapiens
  misc_feature (1)..(1): Xaa can be any naturally occurring amino acid
XAQSLKSVDYEVFGRVQGVCFRMYTEDEARKIGVVGWVKNTSKGTVTGQVQGPEDKVNSILAFPFY

SEQ ID NO: 222 - protein, 270 aa, Homo Sapiens
MDSLEWNWALVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 223 - protein, 391 aa, Homo Sapiens
MDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 224 - protein, 135 aa, Homo Sapiens
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCH

SEQ ID NO: 225 - protein, 152 aa, Homo Sapiens
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPT

SEQ ID NO: 226 - protein, 511 aa, Homo Sapiens
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 227 - protein, 511 aa, Homo Sapiens; identical to SEQ ID NO: 226

SEQ ID NO: 228 - protein, 511 aa, Homo Sapiens; identical to SEQ ID NO: 226

SEQ ID NO: 229 - protein, 469 aa, Homo Sapiens
MMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 230 - protein, 59 aa, Homo Sapiens
MVLLRVLILLLSWAAGMGAPARWRIPKSSPPPRPAAQTRGKLCCLQLGSCIVLYPARRS

SEQ ID NO: 231 - protein, 148 aa, Homo Sapiens
MVLLRVLILLLSWAAGMGDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRN

SEQ ID NO: 232 - protein, 71 aa, Homo Sapiens
MVLLRVLILLLSWAAGMGDRDFDDGVLGLAWVGAPSGSSGGICEKSKLYSDVPTMGKLHSKEKPIKSSSPN

SEQ ID NO: 233 - protein, 115 aa, Homo Sapiens
MVLLRVLILLLSWAAGMGGQYGNPLNKYIRHYEGLSYNVDSLHQKHQRAKRAVSHEDQFLRLDFHAHGRDGVLPCCPGWSQTPGLKRSTCLSLPQCWDYRCEPSPMISVFDYPHK

SEQ ID NO: 234 - protein, 125 aa, Homo Sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYDYPHKYGPQGGCADHSV

SEQ ID NO: 235 - protein, 748 aa, Homo Sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 236 - protein, 38 aa, Homo Sapiens
MVLLRVLILLLSWAAGMGVPTMGKLHSKEKPIKSSSPN

SEQ ID NO: 237 - protein, 58 aa, Homo Sapiens
  misc_feature (1)..(1): Xaa can be any naturally occurring amino acid
XEEGSFSHGSVIDGRFEGFIQTRGGTFYVEPAERYIKDRTLPFHSVIYHEDDISEGLN

SEQ ID NO: 238 - protein, 278 aa, Homo Sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFT

SEQ ID NO: 239 - protein, 909 aa, Homo Sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 240 - protein, 738 aa, Homo Sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 241 - protein, 520 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 242 - protein, 814 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 243 - protein, 796 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRLVLSASRPPLPGRCRLTLCPRDSSLRGQPSPHPQGSHCLPTPRAGAHRVTCPAQGLESRP

SEQ ID NO: 244 - protein, 772 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYSLRGQPSPHPQGSHCLPTPRAGAHRVTCPAQGLESRP

SEQ ID NO: 245 - protein, 839 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQSQGPAKPPPPRKPLPADPQGRCPSGDLPGPGAGIPPLVVPSRPAPPPPTVSSLYL

SEQ ID NO: 246 - protein, 838 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKSQGPAKPPPPRKPLPADPQGRCPSGDLPGPGAGIPPLVVPSRPAPPPPTVSSLYL

SEQ ID NO: 247 - protein, 863 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 248 - protein, 862 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 249 - protein, 797 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKVTVGGEKGTASPPT

SEQ ID NO: 250 - protein, 822 aa, Homo Sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKVTVGGEKGTASPPT

SEQ ID NO: 251 - protein, 824 aa, Homo Sapiens
MRLALLWALGLLGAGSPLPSWPLPNIVLSWGVLGPAGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 252 - protein, 633 aa, Homo Sapiens
MRLALLWALGLLGAGSPLPSWPLPNIVSACNVEAPQVALRSSRQSQRRPRGSPWSPRSFRTISQLASKRCFRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVSSLGGQDQV

SEQ ID NO: 253 - protein, 824 aa, Homo Sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 254 - protein, 285 aa, Homo Sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQLLFE

SEQ ID NO: 255 - protein, 258 aa, Homo Sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIHTDRAN

SEQ ID NO: 256 - protein, 115 aa, Homo Sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLR

SEQ ID NO: 257 - protein, 715 aa, Homo Sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 258 - protein, 739 aa, Homo Sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 259 - protein, 182 aa, Homo Sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 260 - protein, 62 aa, Homo Sapiens
MFLLLALLTELGRLQAHEGSEGIFLHVTVPRKIKSNDSEVSERKVFGEQVVFGYMNDLHHYN

SEQ ID NO: 261 - protein, 330 aa, Homo Sapiens
EEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTEREPQAPEPGHSLAQTVPSQGISPGGSDSPQTGSLDHRYLNPWFKRDYNVAKWVEDVNKNTEGPYFRTLSPAKSPSSSTGSIASSRKYPYPMPPLPDEDKKVNRQSARLWETSI

SEQ ID NO: 262 - protein, 804 aa, Homo Sapiens
MELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQG

SEQ ID NO: 263 - protein, 196 aa, Homo Sapiens
MQAAVAVSVPFLLLCVLGTCPPARCGQAGDASLMELEKRKENRFVERQSIVPLRLIYRSGGEDESRHDALDTRVRGDLGGPQIQMFLKSESQKTIYQIQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQ

SEQ ID NO: 264 - protein, 906 aa, Homo Sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 265 - protein, 859 aa, Homo Sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTE

SEQ ID NO: 266 - protein, 899 aa, Homo Sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 267 - protein, 870 aa, Homo Sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 268 - protein, 342 aa, Homo Sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSYVTSVMMYYFF

SEQ ID NO: 269 - protein, 264 aa, Homo Sapiens
  misc_feature (1)..(1): Xaa can be any naturally occurring amino acid
XCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSAFLSHFQISTCSITHYSISQNISLFCSRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 270 - protein, 217 aa, Homo Sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEF

SEQ ID NO: 271 - protein, 775 aa, Homo Sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 272 - protein, 540 aa, Homo Sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGRRTNPFPCACAKENHFR

SEQ ID NO: 273 - protein, 58 aa, Homo Sapiens
MLQGLLPVSLLLSVAVSAIKELPGVKKYEVVYPIRLHPLHKREAKEPEQQFLSSMKIS

SEQ ID NO: 274 - protein, 387 aa, Homo Sapiens
  misc_feature (1)..(1): Xaa can be any naturally occurring amino acid
XFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFDSNPKA

SEQ ID NO: 275 - protein, 174 aa, Homo Sapiens
  misc_feature (1)..(1): Xaa can be any naturally occurring amino acid
XKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEVNYIVWAVITMAPLCVSLTLLS

SEQ ID NO: 276 - protein, 14 aa, Homo Sapiens
MKMLLLLHCLGVFL

SEQ ID NO: 277 - protein, 44 aa, Homo Sapiens
MKMLLLLHCLGVFLSCSGHIQDEHPQYHSPPDVVIPVRITGTTR

SEQ ID NO: 278 - protein, 90 aa, Homo Sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAIL

SEQ ID NO: 279 - protein, 820 aa, Homo Sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 280 - protein, 820 aa, Homo Sapiens; identical to SEQ ID NO: 279

SEQ ID NO: 281 - protein, 820 aa, Homo Sapiens; identical to SEQ ID NO: 279

SEQ ID NO: 282 - protein, 820 aa, Homo Sapiens; identical to SEQ ID NO: 279

SEQ ID NO: 283 - protein, 820 aa, Homo Sapiens; identical to SEQ ID NO: 279

SEQ ID NO: 284 - protein, 820 aa, Homo Sapiens; identical to SEQ ID NO: 279

SEQ ID NO: 285 - protein, 787 aa, Homo Sapiens
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 286 - protein, 629 aa, Homo Sapiens
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSQDSTQTQSSSN

SEQ ID NO: 287 - protein, 184 aa, Homo Sapiens
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKYDYWGSDSM

SEQ ID NO: 288 - protein, 155 aa, Homo Sapiens
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRSLKEQPMDDNIFISEKSEPAVPDLFPLYLEMHIVVDK

SEQ ID NO: 289 - protein, 53 aa, Homo Sapiens
MIYLYNQGSMNTYSSDIQTQCYYQGNIEGYPDSMVTLSTCSGLRGILQFENVS

SEQ ID NO: 290 - protein, 688 aa, Homo Sapiens
MNVRGAAPGVRASPRPWQFPTSQRLPAGSPEAAPCSASGCCWPGSAASWRQDPEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 291 - protein, 173 aa, Homo Sapiens [sequence omitted]

SEQ ID NO: 292 - protein, 787 aa, Homo Sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 293 - protein, 813 aa, Homo Sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 294 - protein, 812 aa, Homo Sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 295 - protein, 692 aa, Homo Sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 296 - protein, 138 aa, Homo Sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTVRCFHGLWDAPPEVPPHHSYPYSSLHS

SEQ ID NO: 297 - protein, 754 aa, Homo Sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 298 - protein, 776 aa, Homo Sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNQRTPESLESLPTSFSSPHYITLKPASKDSRGIADPNQSAK

SEQ ID NO: 299 - protein, 210 aa, Homo Sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKVSTLLLSLPQMKHLLFS

SEQ ID NO: 300 - protein, 516 aa, Homo Sapiens
MVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNHLLYGRHQ

SEQ ID NO: 301 - protein, 245 aa, Homo Sapiens
MRGLGLWLLGAMMLPAIAPSRPWALMEQYEVVLPWRLPGPRVRRALPSHLGGQFRPQPCPYLSIRGTYYRPARCPGLIQPVAQLRLSQSSAGRAPACTWGLEMQWSSRRLCRHHQGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGP

SEQ ID NO: 302 - protein, 742 aa, Homo Sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAGCQPRAGQGRGSSPIQGPPRAGPHHPPGPARPTPGLLGGSEEAAPCSSGHCVQPTLPSSCLHPAGTKAGHQANVRTPSAPSQTRGWCGQPWSS

SEQ ID NO: 303 - protein, 824 aa, Homo Sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 304 - protein, 109 aa, Homo Sapiens
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQGFLPGGVRPAPDRAPG

SEQ ID NO: 305 - protein, 733 aa, Homo Sapiens
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQGAVGPKVALKPPIQRKQGAGAPTAP

SEQ ID NO: 306 - protein, 655 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGK

SEQ ID NO: 307 - protein, 628 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKK

SEQ ID NO: 308 - protein, 819 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 309 - protein, 712 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNGQMAKIKQTLLDSRGVFLDMFLQ

SEQ ID NO: 310 - protein, 147 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQRCGPLCIREQSTPGDRAGQNTQNNWQMSNLAFCVYY

SEQ ID NO: 311 - protein, 128 aa, Homo Sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQVMYFSLDPIANFKTIII

SEQ ID NO: 312 - protein, 391 aa, Homo Sapiens
MILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 313 - protein, 470 aa, Homo Sapiens
MLRGISQLPAVATMSWVLLPVLWLIVQTQAIAIKQTPELTLHEIVCPKKLHILHKREIKNNQTEKHGKEERYEPEVQYQMILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 314 - protein, 41 aa, Homo Sapiens
MLRGISQLPAVATMSWVLLPVLWLIVQTQASNCAWPKVSIQ

SEQ ID NO: 315 - protein, 171 aa, Homo Sapiens
MLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASM

SEQ ID NO: 316 - protein, 967 aa, Homo Sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 317 - protein, 128 aa, Homo Sapiens
MVTWEGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQT

SEQ ID NO: 318 - protein, 200 aa, Homo Sapiens
  misc_feature (1)..(1): Xaa can be any naturally occurring amino acid
XCRSFLLRPSLCAVLILQFFLFHHFGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCA

SEQ ID NO: 319 - protein, 1103 aa, Homo Sapiens
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 320 - protein, 289 aa, Homo Sapiens
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVRLPNFSRTRVWEAPLTSS

SEQ ID NO: 321 - protein, 289 aa, Homo Sapiens; identical to SEQ ID NO: 320

SEQ ID NO: 322 - protein, 1103 aa, Homo Sapiens; identical to SEQ ID NO: 319

SEQ ID NO: 323 - protein, 590 aa, Homo Sapiens
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 324 - protein, 126 aa, Homo Sapiens
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEGA

SEQ ID NO: 325 - protein, 1509 aa, Homo Sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 326 - protein, 1594 aa, Homo Sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 327 - protein, 232 aa, Homo Sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKGIVTHMSSWVEESVLFFWLFY

SEQ ID NO: 328 - protein, 444 aa, Homo Sapiens
MASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVGGVRAQLMHISWWSRPGLGERDLCARGRWPGGSSD

SEQ ID NO: 329 - protein, 276 aa, Homo Sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHRICARPSPATQTRWTKAAAAASSFLSWMGQNVAWRSGAPRVAAAPWWS

SEQ ID NO: 330 - protein, 1371 aa, Homo Sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 331 - protein, 1340 aa, Homo Sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 332 - protein, 1427 aa, Homo Sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 333 - protein, 344 aa, Homo Sapiens
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLRPVPPSPLPLLATHLCAGRSLSLGPSQEPAPGGGRGPRTPVPTHKRPRFQTLPSSCPLLRPASSRCTPRD

SEQ ID NO: 334 - protein, 344 aa, Homo Sapiens; identical to SEQ ID NO: 333

SEQ ID NO: 335 - protein, 223 aa, Homo Sapiens
MRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 336 - protein, 1226 aa, Homo Sapiens
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGMQGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 337 - protein, 1223 aa, Homo Sapiens
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 338 - protein, 950 aa, Homo Sapiens
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 339 - protein, 1224 aa, Homo Sapiens
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 340 - protein, 570 aa, Homo Sapiens
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMVRS

SEQ ID NO: 341 - protein, 1095 aa, Homo Sapiens
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 342 - protein, 68 aa, Homo Sapiens
MCDGALLPPLVLPVLLLLVWGLDPGTGWPHSAWAGAGANPAPQQLPGPIQWTRTSDQAQMVLDPQPFC

SEQ ID NO: 343 - protein, 214 aa, Homo Sapiens
  misc_feature (1)..(1): Xaa can be any naturally occurring amino acid
XELYCSPLGKESPLLVADRVLDGTPCGPYETDLCVHGKCQKIGCDGIIGSAAKEDRCGVCSGDGKTCHLVKGDFSHARGTGYIEAAVIPAGARRIRVVEDKPAHSFLALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGG

SEQ ID NO: 344 - protein, 120 aa, Homo Sapiens
  misc_feature (1)..(1): Xaa can be any naturally occurring amino acid
XGRPAELCFYSGRVLGHPGSLVSLSACGAAGGLVGLIQLGQEQVLIQPLNNSQGPFSGREHLIRRKWSLTPSPSAEAQRPEQLCKVLTVPQCLGLTWEDLKSGGWSDLEVPHSCVWPGGG

SEQ ID NO: 345 - protein, 1221 aa, Homo Sapiens
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 346 - protein, 274 aa, Homo Sapiens
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKCICSQASHRGHLSKV

SEQ ID NO: 347 - protein, 62 aa, Homo Sapiens
  misc_feature (1)..(1): Xaa can be any naturally occurring amino acid
XQGRPSSSCLLHQKPPVLRACNTNFCPAPEKRDSAGSQLPCCDGPQAVHEEGLRFPDNHWAM

SEQ ID NO: 348 - protein, 186 aa, Homo Sapiens
  misc_feature (1)..(1): Xaa can be any naturally occurring amino acid
XVDSAGSYISHDILHNGRKKRSAQNARSSLHYRFSAFGQELHLELKPSAILSSHFIVQVLGKDGASETQKPEVQQCFYQGFIRNDSSSSVAVSTCAGLLLAQEHNYSSPAGHHPHVLYKRTAEEKIQRYRGYPGSGRNYPGYSPSHIPHASQSRETEYHHRRLQKQHFCGRRKKCICSQASHRGHL

SEQ ID NO: 349 - protein, 37 aa, Homo Sapiens
MGKNREMRLTHICCCCLLYQLGFLSNGIVSDGIYTAQ

SEQ ID NO: 350 - protein, 1213 aa, Homo Sapiens
MGKNREMRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 351 - protein, 1207 aa, Homo Sapiens
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 352 - protein, 145 aa, Homo Sapiens
  misc_feature (1)..(1): Xaa can be any naturally occurring amino acid
XDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVGKL

SEQ ID NO: 353 - protein, 1211 aa, Homo Sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 354 - protein, 566 aa, Homo Sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 355 - protein, 106 aa, Homo Sapiens
VTCGNGTQERPVLCRTADDSFGICQEERPETARTCRLGPCPRNISDPSKKSYVVQWLSRPDPDSPIRKISSSNRPVYNSASALQCMPCALWSLPWAPLLSVYGKLP

SEQ ID NO: 356 - protein, 1910 aa, Homo Sapiens
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSCSASCGKGRKYREVFCIDQFQRKLEDTNCSQVQKPPTHKACRSVRCPSWKANSWNECSVTCGSGVQQRDVYCRLKGVGQVVEEMCDQSTRPCSQRRCWSQDCVQHKGMERGRLNCSTSCERKDSHQRMECTDNQIRQVNEIVYNSSTISLTSKNCRNPPCNYIVVTADSSQCANNCGFSYRQRITYCTEIPSTKKHKLHRLRPIVYQECPVVPSSQVYQCINSCLHLATWKVGKWSKCSVTCGIGIMKRQVKCITKHGLSSDLCLNHLKPGAQKKCYANDCKSFTTCKEIQVKNHIRKDGDYYLNIKGRIIKIYCADMYLENPKEYLTLVQGEENFSEVYGFRLKNPYQCPFNGSRREDCECDNGHLAAGYTVFSKIRIDLTSMQIKTTDLLFSKTIFGNAVPFATAGDCYSAFRCPQGQFSINLSGTGMKISSTAKWLTQGSYTSVSIRRSEDGTRFFGKCGGYCGKCLPHMTTGLPIQVI

SEQ ID NO: 357 - protein, 1504 aa, Homo Sapiens
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 358 - protein, 1504 aa, Homo Sapiens [sequence omitted]

SEQ ID NO: 359 - protein, 634 aa, Homo Sapiens
YSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 360 - protein, 1205 aa, Homo Sapiens
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRRTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 361 - protein, 1205 aa, Homo Sapiens; identical to SEQ ID NO: 360

SEQ ID NO: 362 - protein, 930 aa, Homo Sapiens
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDGSPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRLYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 363 - protein, 292 aa, Homo Sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVRLPNFTVIPA

SEQ ID NO: 364 - protein, 1117 aa, Homo Sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 365 - protein, 1686 aa, Homo Sapiens
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 366 - protein, 889 aa, Homo Sapiens
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 367 - protein, 69 aa, Homo Sapiens
AKCPQGRFSINLYGTGLSLTESARWISQGNYAVSDIKKSPDGTRVVGKCGGYCGKCTPSSGTGLEVRVL

SEQ ID NO: 368 - protein, 1907 aa, Homo Sapiens
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 369 - protein, 1935 aa, Homo Sapiens
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 370 - protein, 488 aa, Homo Sapiens
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLE

SEQ ID NO: 371 - protein, 991 aa, Homo Sapiens
  misc_feature (1)..(1): Xaa can be any naturally occurring amino acid
XECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 372 - protein, 127 aa, Homo Sapiens
MARLEAPQCPGFLARLLGGTWCLLCIAGQVCGDQSQGAVFLREFTLIRRESLHEDFLSDLLNSHKTEDSSSRTARSEEDRDGLWDAWGPWSECSRTCGGGASYSLRRCLSSKSCEGRNIRYRTCSNV

SEQ ID NO: 373 - protein, 219 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKCKTHRDGRPLDLLTYPLLA

SEQ ID NO: 374 - protein, 683 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARSSIDSAWNACNVLC

SEQ ID NO: 375 - protein, 525 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPS

SEQ ID NO: 376 - protein, 1762 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTINCQVAGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 377 - protein, 439 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPARWEATPWTACSSSCGGGIQSRAVSCVEEDIQGHVTSVEEWKCMYTPKMPIAQPCNIFDCPKWLAQEWSPVTVPSFFVH

SEQ ID NO: 378 - protein, 185 aa, Homo Sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQVSADLFSFNLSRGFQCLCVNGLHSLTL

SEQ ID NO: 379 - protein, 258 aa, Homo Sapiens
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRAMGLASGLT

SEQ ID NO: 380 - protein, 463 aa, Homo Sapiens
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 381 - protein, 275 aa, Homo Sapiens
MSGVFCFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQVQWALHRASPSCATQTSLLPDTGWHHLTIRAVQCSSEACEHPELLVRGLQCTLESQPVDPVHSYLWQLRLPVPACGVCACPHQQGSA

SEQ ID NO: 382 - protein, 150 aa, Homo Sapiens
TSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSR

SEQ ID NO: 383 - protein, 951 aa, Homo Sapiens
MDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 384 - protein, 951 aa, Homo Sapiens; identical to SEQ ID NO: 383

SEQ ID NO: 385 - protein, 1060 aa, Homo Sapiens
MLFEVGEGGGAGEEGKGRGRPGRSLCTHAAPARTAHLAPSALRSARPFLWEDNLLTRSQGLPDNHDQLVPDNLEAWALAGPRGLFPKRTLVIWKRIGAGLVVTVALLPRMDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 386 - protein, 1691 aa, Homo Sapiens
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 387 - protein, 1682 aa, Homo Sapiens
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDSTYTSQTATNKGAASHVKRDKPLEGS

SEQ ID NO: 388 - protein, 1074 aa, Homo Sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 389 - protein, 1097 aa, Homo Sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEAPLLPLRHAFFLLPGAGSGDSTGVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 390 - protein, 1074 aa, Homo Sapiens; identical to SEQ ID NO: 388

SEQ ID NO: 391 - protein, 877 aa, Homo Sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 392 - protein, 471 aa, Homo Sapiens
MDSAPLFPRPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 393 - protein, 131 aa, Homo Sapiens
MGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPGPSAGPPPPGPGDPL

SEQ ID NO: 394 - protein, 130 aa, Homo Sapiens
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHG

SEQ ID NO: 395 - protein, 141 aa, Homo Sapiens
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLA

SEQ ID NO: 396 - protein, 210 aa, Homo Sapiens
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDA

SEQ ID NO: 397 - protein, 135 aa, Homo Sapiens
RHIRVEHRSRNHLGILGSLMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAP

SEQ ID NO: 398 - protein, 455 aa, Homo Sapiens
MARKALKLASWTSMALAASGIYFYSNKYLDPNDFGAVRVGRAVATTAVISYDYLTSLKSVPYGSEEYLQLRSKIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 399 - protein, 122 aa, Homo Sapiens
MARKALKLASWTSMALAASGIYFYSNKYLDPNDFGAVRVGRAVATTAVISYDYLTSLKSVPYGSEEYLQLRSKSLAVSPRLECIGVISAHCNLYLLGSSDSPASASQVAGTTGAPSLCQASL

SEQ ID NO: 400 - protein, 266 aa, Homo Sapiens
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKISRHLGKMYSEMIFVNGFV

SEQ ID NO: 401 - protein, 523 aa, Homo Sapiens
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 402 - protein, 218 aa, Homo Sapiens
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEVLVLAVKQLFPEFEFMWLVDEAKKNLPLELDFLNEGRNAEKVSQMLRHFDFLKPGQQSETASQGTTTTTKKKWDRKL

SEQ ID NO: 403 - protein, 176 aa, Homo Sapiens
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 404 - protein, 176 aa, Homo Sapiens; identical to SEQ ID NO: 403

SEQ ID NO: 405 - protein, 74 aa, Homo Sapiens
MAGVVHVSLAALLLLPMAPAMHSDCIFKKEQAMCLEKIQRANELMGFNDSSPGCPGMWDNITCWKPAHVGEMVL

SEQ ID NO: 406 - protein, 447 aa, Homo Sapiens
MAGVVHVSLAALLLLPMAPAMHSDCIFKKEQAMCLEKIQRANELMGFNDSSPGCPGMWDNITCWKPAHVGEMVLVSCPELFRIFNPDQDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 407 - protein, 468 aa, Homo Sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 408 - protein, 524 aa, Homo Sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLTNLSPRVPKKAREDPLPVPSDQHSLPFLSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 409 - protein, 496 aa, Homo Sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYFSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 410 - protein, 496 aa, Homo Sapiens; identical to SEQ ID NO: 409

SEQ ID NO: 411 - protein, 148 aa, Homo Sapiens
  misc_feature (1)..(1): Xaa can be any naturally occurring amino acid
XATLRLYFDDTGCWDMNDSTALWWVIKGPVVGSIMVNFVLFIGIIVILVQKLQSPDMGGNESSIYLTNLSPRVPKKAREDPLPVPSDQHSLPFLRLARSTLLLIPLFGIHYTVFAFSPENVSKRERLVFELGLGSFQGFVVAVLYCFL

SEQ ID NO: 412 - protein, 97 aa, Homo Sapiens
MASYIDQDMQVLWYQDGRIVETDESQGIFVEKNMIHNCSLIASALTISNIQAGSTGNWGCHVQTKRGNNTRTVDIVVLESSAQYCPPERVVNNKGDF

SEQ ID NO: 413 - protein, 1321 aa, Homo Sapiens
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 414 - protein, 616 aa, Homo Sapiens
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 415 - protein, 34 aa, Homo Sapiens
MLRFYLIGGGIPIIVCGITAAANIKNYGSRPNAP

SEQ ID NO: 416 - protein, 381 aa, Homo Sapiens
MPLKRNNSKYPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKGKFR

SEQ ID NO: 417 - protein, 847 aa, Homo Sapiens
GKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQ

SEQ ID NO: 418 - protein, 1585 aa, Homo Sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 419 - protein, 1584 aa, Homo Sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 420 - protein, 1551 aa, Homo Sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 421 - protein, 507 aa, Homo Sapiens
MHLPRQHGSAHLGHLYAYAKFSAHDWHLHAQGHAICNAHGKGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCP

SEQ ID NO: 422 - protein, 1500 aa, Homo Sapiens
MLSLRGPDTHGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 423 - protein, 1554 aa, Homo Sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 424 - protein, 1499 aa, Homo Sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 425 - protein, 1466 aa, Homo Sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 426 - protein, 906 aa, Homo Sapiens
MEKLLRLCCWYSWLLLFYYNFQVRGVYSRSQDHPGFQVLASASHYWPLENVDGIHELQDTTGASRTHKLTVLPSRNATFVYSNDSAYSNLSATVDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 427 - protein, 221 aa, Homo Sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIIT

SEQ ID NO: 428 - protein, 874 aa, Homo Sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 429 - protein, 393 aa, Homo Sapiens
MHRVCFLSFQTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 430 - protein, 345 aa, Homo Sapiens
MQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEARWAKEGRAESLSRMVAGQKGCMITKPSDPLIATPSDPLQGLRWIPVAGRQCSHGSPPAHPPACPPRICLFASLSHSPRDIHC

SEQ ID NO: 431 - protein, 156 aa, Homo Sapiens
MQVVPLEVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 432 - protein, 437 aa, Homo Sapiens
MNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 433 - protein, 57 aa, Homo Sapiens
MQGPLLLPGLCFLLSLFGAVTQKTKSECSEPEQRTCGPRAGPGATHGLQWAGEKCLF

SEQ ID NO: 434 - protein, 526 aa, Homo Sapiens
MQGPLLLPGLCFLLSLFGAVTQKTKTSCAKCPPNASCVNNTHCTCNHGYTSGSGQKLFTFPLETCNAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 435 - protein, 652 aa, Homo Sapiens
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 436 - protein, 600 aa, Homo Sapiens
MQGPLLLPGLCFLLSLFGAVTQKTKTSCAKCPPNASCVNNTHCTCNHGYTSGSGQKLFTFPLETCNDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 437 - protein, 786 aa, Homo Sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 438 - protein, 835 aa, Homo Sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 439 - protein, 742 aa, Homo Sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 440 - protein, 164 aa, Homo Sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVNECTSGQNPCHSSTHCLNNVGSYQCRCRPGWQPIPGSPNGPNNTVCE

SEQ ID NO: 441 - protein, 154 aa, Homo Sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQGKNHPTSSDFPSMRFGVTRAILAASREQGLGCRVSAWRL

SEQ ID NO: 442 - protein, 157 aa, Homo Sapiens [sequence omitted]

SEQ ID NO: 443 - protein, 160 aa, Homo Sapiens
EYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRPV

SEQ ID NO: 444 - protein, 713 aa, Homo Sapiens
MDISIQRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 445 - protein, 218 aa, Homo Sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRMSLLSPKLECNGTI

SEQ ID NO: 446 - protein, 910 aa, Homo Sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 447 - protein, 137 aa, Homo Sapiens
  misc_feature (1)..(1): Xaa can be any naturally occurring amino acid
XWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRTVIHLWNLV

SEQ ID NO: 448 - protein, 6 aa, Homo Sapiens
MTPQSL

SEQ ID NO: 449 - protein, 95 aa, Homo Sapiens
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQ

SEQ ID NO: 450 - protein, 125 aa, Homo Sapiens
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMC

SEQ ID NO: 451 - protein, 90 aa, Homo Sapiens
MTPQSLLQTTLFLLSLLFLVQAPATGSHLQPLPPQVPTAGATGKTFASAASGTRHTGAASTTNPHQTCASPSRTPKRPSQSMPLSLQPTL

SEQ ID NO: 452 - protein, 118 aa, Homo Sapiens
MTPQSLLQTTLFLLSLLFLVQAPATGSHLQPLPPQVPTAGATGKTFASAASGTRHTGAASTTNPHQTCASPSRTPKRPSQSMPLSLQPTLLPDPSLTPGASTTSASTGTDMLGDYIFS

SEQ ID NO: 453 - protein, 91 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRG

SEQ ID NO: 454 - protein, 98 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLY

SEQ ID NO: 455 - protein, 103 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHA

SEQ ID NO: 456 - protein, 114 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRD

SEQ ID NO: 457 - protein, 118 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 458 - protein, 118 aa, Homo Sapiens; identical to SEQ ID NO: 457

SEQ ID NO: 459 - protein, 125 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLL

SEQ ID NO: 460 - protein, 145 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSV

SEQ ID NO: 461 - protein, 146 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVT

SEQ ID NO: 462 - protein, 164 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTF

SEQ ID NO: 463 - protein, 168 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHS

SEQ ID NO: 464 - protein, 198 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHP

SEQ ID NO: 465 - protein, 692 aa, Homo Sapiens
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 466 - protein, 97 aa, Homo Sapiens
MTPQSLLQTTLFLLSLLFLVQASGTRHTGAASTTNPHQTCASPSRTPKRPSQSMPLSLQPTLLPDPSLTPGASTTSASTGTDMLGDYIFSMASVTSC

SEQ ID NO: 467 - protein, 97 aa, Homo Sapiens; identical to SEQ ID NO: 466

SEQ ID NO: 468 - protein, 97 aa, Homo Sapiens; identical to SEQ ID NO: 466

SEQ ID NO: 469 - protein, 68 aa, Homo Sapiens
MTPQSLLQTTLFLLSLLFLVQASSLLCFQHQEESLAQGPPLLATSVTSWWSPQNISLPSAASFTFSFH

SEQ ID NO: 470 - protein, 42 aa, Homo Sapiens
MTPQSLLQTTLFLLSLLFLVQGAHGRGHREDFRFCSQRNQTH

SEQ ID NO: 471 - protein, 50 aa, Homo Sapiens
MTPQSLLQTTLFLLSLLFLVQGAHGRGHREDFRFCSQRNQTHRSSLHYKP

SEQ ID NO: 472 - protein, 55 aa, Homo Sapiens
MTPQSLLQTTLFLLSLLFLVQGAHGRGHREDFRFCSQRNQTHRSSLHYKPTPDLR

SEQ ID NO: 473 - protein, 56 aa, Homo Sapiens
MTPQSLLQTTLFLLSLLFLVQGAHGRGHREDFRFCSQRNQTHRSSLHYKPTPDLRI

SEQ ID NO: 474 - protein, 70 aa, Homo Sapiens
MTPQSLLQTTLFLLSLLFLVQGAHGRGHREDFRFCSQRNQTHRSSLHYKPTPDLRISIENSEEALTVHAP

SEQ ID NO: 475 - protein, 77 aa, Homo Sapiens
MTPQSLLQTTLFLLSLLFLVQGAHGRGHREDFRFCSQRNQTHRSSLHYKPTPDLRISIENSEEALTVHAPFPAAHPA

SEQ ID NO: 476 - protein, 84 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDP

SEQ ID NO: 477 - protein, 84 aa, Homo Sapiens; identical to SEQ ID NO: 476

SEQ ID NO: 478 - protein, 94 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYW

SEQ ID NO: 479 - protein, 94 aa, Homo Sapiens; identical to SEQ ID NO: 478

SEQ ID NO: 480 - protein, 100 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGR

SEQ ID NO: 481 - protein, 107 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGK

SEQ ID NO: 482 - protein, 110 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDF

SEQ ID NO: 483 - protein, 111 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFL

SEQ ID NO: 484 - protein, 113 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 485 - protein, 116 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKA

SEQ ID NO: 486 - protein, 116 aa, Homo Sapiens; identical to SEQ ID NO: 485

SEQ ID NO: 487 - protein, 119 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSL

SEQ ID NO: 488 - protein, 119 aa, Homo Sapiens; identical to SEQ ID NO: 487

SEQ ID NO: 489 - protein, 122 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCF

SEQ ID NO: 490 - protein, 131 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQ

SEQ ID NO: 491 - protein, 131 aa, Homo Sapiens; identical to SEQ ID NO: 490

SEQ ID NO: 492 - protein, 141 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVT

SEQ ID NO: 493 - protein, 153 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPS

SEQ ID NO: 494 - protein, 154 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSA

SEQ ID NO: 495 - protein, 160 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFS

SEQ ID NO: 496 - protein, 162 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFH

SEQ ID NO: 497 - protein, 167 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHT

SEQ ID NO: 498 - protein, 167 aa, Homo Sapiens; identical to SEQ ID NO: 497

SEQ ID NO: 499 - protein, 199 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRR

SEQ ID NO: 500 - protein, 687 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 501 - protein, 687 aa, Homo Sapiens; identical to SEQ ID NO: 500

SEQ ID NO: 502 - protein, 687 aa, Homo Sapiens; identical to SEQ ID NO: 500

SEQ ID NO: 503 - protein, 687 aa, Homo Sapiens; identical to SEQ ID NO: 500

SEQ ID NO: 504 - protein, 693 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 505 - protein, 693 aa, Homo Sapiens; identical to SEQ ID NO: 504

SEQ ID NO: 506 - protein, 687 aa, Homo Sapiens; identical to SEQ ID NO: 500

SEQ ID NO: 507 - protein, 256 aa, Homo Sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQE

SEQ ID NO: 508 - protein, 78 aa, Homo Sapiens
MTPQSLLQTTLFLLSLLFLVQGRCPRQGPQGRLSLLQPAEPDTQEQPPLQTHTRPAHLHRELRRGPHSPCPFPCSPPC

SEQ ID NO: 509 - protein, 81 aa, Homo Sapiens
MTPQSLLQTTLFLLSLLFLVQGRCPRQGPQGRLSLLQPAEPDTQEQPPLQTHTRPAHLHRELRRGPHSPCPFPCSPPCFPI

SEQ ID NO: 510 - protein, 97 aa, Homo Sapiens
MTPQSLLQTTLFLLSLLFLVQGSGTRHTGAASTTNPHQTCASPSRTPKRPSQSMPLSLQPTLLPDPSLTPGASTTSASTGTDMLGDYIFSMASVTSC

SEQ ID NO: 511 - protein, 97 aa, Homo Sapiens; identical to SEQ ID NO: 510

SEQ ID NO: 512 - protein, 187 aa, Homo Sapiens
  misc_feature (1)..(1): Xaa can be any naturally occurring amino acid
XSVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVFGTYVPGYLLKLSAMGWGFPIFLVTLVALVDVDNYGPIILAVHRTP

SEQ ID NO: 513 - protein, 528 aa, Homo Sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 514 - protein, 528 aa, Homo Sapiens; identical to SEQ ID NO: 513

SEQ ID NO: 515 - protein, 221 aa, Homo Sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLVLLGAPPFPLHPCPSVTLLLNTGLTRPKPVEPSWKSITL

SEQ ID NO: 516 - protein, 141 aa, Homo Sapiens
MFRSDRMWSCHWKWKPSPLLFLFALYIMCVPHSAVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKG

SEQ ID NO: 517 - protein, 241 aa, Homo Sapiens
MFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEK

SEQ ID NO: 518 - protein, 1221 aa, Homo Sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 519 - protein, 1193 aa, Homo Sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 520 - protein, 1250 aa, Homo Sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 521 - protein, 1222 aa, Homo Sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 522 - protein, 103 aa, Homo Sapiens
  misc_feature (1)..(1): Xaa can be any naturally occurring amino acid
XLGSTLMNIFSNILSSSDSDLLESSSEALKTIDELAFKIDLNSTSHVNITTRNLALSVSSLLPGTNAISNFSIGLPSNNESYFQLLSFTTCFEKTSKSAADGF

SEQ ID NO: 523 - protein, 135 aa, Homo Sapiens
  misc_feature (1)..(1): Xaa can be any naturally occurring amino acid
XVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRIW

SEQ ID NO: 524 - protein, 73 aa, Homo Sapiens
GQNLIRSIQINITRLAGTFGDVAVGLRISSDHKEQPIVTENAERQLVVKDGATYKVDVVPIKNQVVGCQSLPW

SEQ ID NO: 525 - protein, 123 aa, Homo Sapiens
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDV

SEQ ID NO: 526 - protein, 123 aa, Homo Sapiens; identical to SEQ ID NO: 525

SEQ ID NO: 527 - protein, 334 aa, Homo Sapiens
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 528 - protein, 192 aa, Homo Sapiens
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQVLVSVSVIMNLVKAARRGAP

SEQ ID NO: 529 - protein, 148 aa, Homo Sapiens
MAKRSAAAAVPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQLPSIAVSEPKGRNESMPLTLIREKG

SEQ ID NO: 530 - protein, 2038 aa, Homo Sapiens
MINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRL

SEQ ID NO: 531 - protein, 6306 aa, Homo Sapiens
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 532 - protein, 6306 aa, Homo Sapiens; identical to SEQ ID NO: 531

SEQ ID NO: 533 - protein, 938 aa, Homo Sapiens
NSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKRNATEPIIKSFS

SEQ ID NO: 534 - protein, 2624 aa, Homo Sapiens
QLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 535 - protein, 390 aa, Homo Sapiens
TFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVCGISSVS

SEQ ID NO: 536 - protein, 99 aa, Homo Sapiens
VPHITVEEEDGEIRLLVIRAQGLLGRVTAEFRTVSLTAFSPEDYQNVAGTLEFQPGERYKYIFINITDNSIPELEKSFKVELLNLEGGVCEFLVRAGDE

SEQ ID NO: 537 - protein, 80 aa, Homo Sapiens
  misc_feature (1)..(1): Xaa can be any naturally occurring amino acid
XDEQLSAMMHLIEKITTEGKIQAFSVASRTLFYEILCSLINPKRKDTRGFSHFAEVTENFAFSLLTNVTCGSPGEKSPAC

SEQ ID NO: 538 - protein, 72 aa, Homo Sapiens
  misc_feature (1)..(1): Xaa can be any naturally occurring amino acid
XEGSTISCVVERTRGALDYVHVFYTISQIETDGINYLVDDFANASGTITFLPWQRSELLIEVSLPIIIYNCN

SEQ ID NO: 539 - protein, 567 aa, Homo Sapiens
  misc_feature (1)..(1): Xaa can be any naturally occurring amino acid
XITVEEEDGEIRLLVIRAQGLLGRVTAEFRTVSLTAFSPEDYQNVAGTLEFQPGERYKYIFINITDNSIPELEKSFKVELLNLEGGAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGYPSATN

SEQ ID NO: 540 - protein, 65 aa, Homo Sapiens
  misc_feature (1)..(1): Xaa can be any naturally occurring amino acid
XLPTIHKRASLGVASQILVTIAASDHAHGVFEFSPESLFVSGTEPEDGYSTVTLNFQILHVLGLR

SEQ ID NO: 541 - protein, 173 aa, Homo Sapiens
MSVKSSKLMFLCHGSSRSLHSGSLTSCNTGVCCSLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 542 - protein, 179 aa, Homo Sapiens
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 543 - protein, 117 aa, Homo Sapiens
  misc_feature (1)..(1): Xaa can be any naturally occurring amino acid
XRWECCAFSPGPACVVALAVASLPLNCAASADSKRGRWARDSSTCASRRVCGAAGDVRGDSCPSVAASVAPACDPGGQNYTKAMRLFVGEPVWTAYNRPADHFEARGQYVKFLAQTA

SEQ ID NO: 544 - protein, 59 aa, Homo Sapiens
MKYPLMPLVNDLTFSFLVFWFCLPVGLLLLLIIWLRFLLSQDILQVRRYRYDANILTAS

SEQ ID NO: 545 - protein, 80 aa, Homo Sapiens
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 546 - protein, 80 aa, Homo Sapiens; identical to SEQ ID NO: 545

SEQ ID NO: 547 - protein, 179 aa, Homo Sapiens
  misc_feature (1)..(1): Xaa can be any naturally occurring amino acid
XWFCLPVGLLLLLIIWLRFLLSQDSEENDSSVCLDWEPWSKGPAEFCWKGTLHGQEKERPCCLVFLESAGQWQWQKWMGETCQGGKRTLATVVPPWNPQLISSSDRHVKASRGPSPSPASQMTSSPAGSRSSLGGHGSSEQAHGEKLANLIQRGLKAGLGRRVWVHIKEARVFPYPGDP

SEQ ID NO: 548 - protein, 244 aa, Homo Sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 549 - protein, 244 aa, Homo Sapiens; identical to SEQ ID NO: 548

SEQ ID NO: 550 - protein, 117 aa, Homo Sapiens
MGSQVAFLPPPPARSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 551 - protein, 83 aa, Homo Sapiens
MKLVSVALMYLGSLAFLGADTARLDVASEFRKKWNKWALSRGKRELRMSSSYPTGLADVKAGPAQTLIRPQDMKGASRSPEDR

SEQ ID NO: 552 - protein, 83 aa, Homo Sapiens; identical to SEQ ID NO: 551

SEQ ID NO: 553 - protein, 139 aa, Homo Sapiens
MKLVSVALMYLGSLAFLGADTARLDVASEFRKKWNKWALSRGKRELRMSSSYPTGLADVKAGPAQTLIRPQDMKGASRSPEDSCLSSPSPRPQQSGCRPHPSQALPPEHEQLPGPPELWLPLRDVHGAEAGTPDLPVHR

SEQ ID NO: 554 - protein, 185 aa, Homo Sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 555 - protein, 185 aa, Homo Sapiens; identical to SEQ ID NO: 554

SEQ ID NO: 556 - protein, 185 aa, Homo Sapiens; identical to SEQ ID NO: 554

SEQ ID NO: 557 - protein, 138 aa, Homo Sapiens
MSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 558 - protein, 148 aa, Homo Sapiens
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 559 - protein, 148 aa, Homo Sapiens; identical to SEQ ID NO: 558

SEQ ID NO: 560 - protein, 153 aa, Homo Sapiens
MTIHILILLLLLAFSAQGDLDTAARRGQHQVPQHRGHVCYLGVCRTHRLAEIIYWIRCLHQGALGEGQPRAPGPLQLWAPPVARGGSPARFPGFRPAARGLAQCPARWVTSGTARPLLGFSLPICMLELLLHISSPLTPAPETVFPSPSPGCD

SEQ ID NO: 561 - protein, 57 aa, Homo Sapiens
LLEPELPGSALRSLWSSLCLGPAPAPPGPVSPEGRLAAAWDALIVRPVRRWRRVAVG

SEQ ID NO: 562 - protein, 222 aa, Homo Sapiens
MAASCRVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 563 - protein, 78 aa, Homo Sapiens
MALWRGSAYAGFLALAVGCVFLLEPELPGSALRSLWSSLCLGPAPAPPGPVSPEGRLAAAWDALIVRPVRRWRRVAVG

SEQ ID NO: 564 - protein, 78 aa, Homo Sapiens; identical to SEQ ID NO: 563

SEQ ID NO: 565 - protein, 78 aa, Homo Sapiens; identical to SEQ ID NO: 563

SEQ ID NO: 566 - protein, 113 aa, Homo Sapiens
MALWRGSAYAGFLALAVGCVFLLEPELPGSALRSLWSSLCLGPAPAPPGPVSPEGRLAAAWDALIVRPVRRWRRVAVGFFFAVQLVQSYMSFLMTMSLFHQSHCRKWMSSTSF

SEQ ID NO: 567 - protein, 496 aa, Homo Sapiens
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 568 - protein, 154 aa, Homo Sapiens
MGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRK

SEQ ID NO: 569 - protein, 204 aa, Homo Sapiens
  misc_feature (1)..(1): Xaa can be any naturally occurring amino acid
XEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAAGLSRGDFPWAE

SEQ ID NO: 570 - protein, 26 aa, Homo Sapiens
  misc_feature (1)..(1): Xaa can be any naturally occurring amino acid
XKRLLEVLASQGHILAAGCGACLLLQ

SEQ ID NO: 571 - protein, 363 aa, Homo Sapiens
MAAAAMAAAAGGGAGAARSLSRFRGCLAGALLGDCVGSFYEAHDTVDLTSVLRHVQSLEPDPGTPGSERTEALYYTDDTAMARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 572 - protein, 69 aa, Homo Sapiens
KPDAERQTDEEKEELKKPKKEDSSPKEETDKWAVEKGKDHKEPRKGEELEEEWTPTEKVRPLCRRSPSG

SEQ ID NO: 573 - protein, 54 aa, Homo Sapiens
LMKVVNEECPTITRTYSLGKSSRGLKIYAMEISDNPGEHELGEGLWGPAAGLCC

SEQ ID NO: 574 - protein, 1158 aa, Homo Sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 575 - protein, 162 aa, Homo Sapiens
MPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYED

SEQ ID NO: 576 - protein, 733 aa, Homo Sapiens
MRKWWAPCPGSWLCSHCLGEGWALRGAGSTALRPASPQTFHGNVDKDTPVLSELPEPVVARFIRIYPLTWNGSLCMRLEVLGCSVARECGGLAGALSGGGVLGWASRHPAKDNPASLAAVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 577 - protein, 104 aa, Homo Sapiens
RTQWIEVDTRRTTRFTGVITQGRDSSIHDDFVTTFFVGFSNDSQTWVMYTNGYEEMVGTMPRLLALLPLSGRGVGSQRGWQYCSEACLSPDLSWERGQGHTRAE

SEQ ID NO: 578 - protein, 251 aa, Homo Sapiens
  misc_feature (1)..(1): Xaa can be any naturally occurring amino acid
XELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPPVKPLLPPLPPDYGDGYVIPNYDDMDYYFGPPPPQKPDAERQTDEEKEELKKPKKEDSSPKEETDKWAV

SEQ ID NO: 579 - protein, 66 aa, Homo Sapiens
  misc_feature (1)..(1): Xaa can be any naturally occurring amino acid
XFRHHSYKDMRQLMKVVNEECPTITRTYSLGKSSRGLKIYAMEISDNPGEHELGEGLWGPAAGLCC

SEQ ID NO: 580 - protein, 481 aa, Homo Sapiens
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 581 - protein, 160 aa, Homo Sapiens
MCATPPSLNFKKLAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSY

SEQ ID NO: 582 - protein, 80 aa, Homo Sapiens
  misc_feature (1)..(1): Xaa can be any naturally occurring amino acid
XIHRLKQSLPKRKPGFMAKSYDPIAPIAEEISEEACLLCFDEFQVTDIADAMILKQLFENLFKNGVVVVATSNRPPEGIL

SEQ ID NO: 583 - protein, 349 aa, Homo Sapiens
  misc_feature (1)..(1): Xaa can be any naturally occurring amino acid
XKPFWKGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 584 - protein, 599 aa, Homo Sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 585 - protein, 622 aa, Homo Sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGKRRQNESFIRCELFSLILTDLTLFVN

SEQ ID NO: 586 - protein, 609 aa, Homo Sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 587 - protein, 346 aa, Homo Sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 588 - protein, 155 aa, Homo Sapiens
RKVLEHTTHTLLVGESATTFAQSMGFINEDLSTTASQALHSDWLARNCQPNYWRNVIPDPSKYCGPYKPPGILKQDIPIHKETEDDRGHDTIGDSPIPGAGAYADDTAGAAAATGNGDILMRFLPSYQAVEYMRRGEDPTIACQKVISRIQKHFP

SEQ ID NO: 589 - protein, 138 aa, Homo Sapiens
  misc_feature (1)..(1): Xaa can be any naturally occurring amino acid
XGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGDSPIPGAGAYADD

SEQ ID NO: 590 - protein, 342 aa, Homo Sapiens
MAAGTAVGAWVLVLSLWGAVVGAQNITARIGEPLVLKCKGAPKKPPQRLEWKLGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 591 - protein, 234 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 592 - protein, 128 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQFENLHNYSL

SEQ ID NO: 593 - protein, 404 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 594 - protein, 347 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 595 - protein, 233 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 596 - protein, 363 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 597 - protein, 420 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 598 - protein, 153 aa, Homo Sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGILGGLGTAALLIGVILWQRRQRRGEERKAPENQEEEEERAELNQSEEPEAGESSTGGP

SEQ ID NO: 599 - protein, 133 aa, Homo Sapiens
MKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 600 - protein, 294 aa, Homo Sapiens
MNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIGSVGGSGLGTLALALGILGGLGTAALLIGVILWQRRQRRGEERKAPENQEEEEERAELNQSEEPEAGESSTGGP

SEQ ID NO: 601 - protein, 394 aa, Homo Sapiens
MENTDSDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 602 - protein, 65 aa, Homo Sapiens
MTVFFKTLRNHWKKTTAGLCLLTWGGHWLYGKHCDNLLRRAACQEAQHYQDESRWEPTLSRTPGS

SEQ ID NO: 603 - protein, 422 aa, Homo Sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 604 - protein, 244 aa, Homo Sapiens
MTVFFKTLRNHWKKTTAGLCLLTWGGHWLYGKHCDNLLRRAACQEAQVFGNQLIPPNAQVKKATVFLNPAACKGTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKPFPKR

SEQ ID NO: 605 - protein, 244 aa, Homo Sapiens; identical to SEQ ID NO: 604

SEQ ID NO: 606 - protein, 46 aa, Homo Sapiens
MTVFFKTLRNHWKKTTAGLCLLTWGGHWLYGKHWCLAINSFLPMHK

SEQ ID NO: 607 - protein, 189 aa, Homo Sapiens
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRGISDPLTVFEQTEAAAREEILANGGSLSHHHGVGKLRKQWLKESISDVGFGMLKSVKEYVDPNNIFGNRNLL

SEQ ID NO: 608 - protein, 658 aa, Homo Sapiens
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 609 - protein, 543 aa, Homo Sapiens
  misc_feature (1)..(1): Xaa can be any naturally occurring amino acid
XQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGGLQLEGTCYES

SEQ ID NO: 610 - protein, 560 aa, Homo Sapiens
  misc_feature (1)..(1): Xaa can be any naturally occurring amino acid
XYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGEHEPHSTSTHHGRYRIPQICGRSFPPLDNFQDSSRFLPEPSTQECISPWFHHIHSLPF

SEQ ID NO: 611 - protein, 131 aa, Homo Sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFV

SEQ ID NO: 612 - protein, 188 aa, Homo Sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVR

SEQ ID NO: 613 - protein, 175 aa, Homo Sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 614 - protein, 119 aa, Homo Sapiens
PLMIIHHLDECPHSQALKKVFAENKEIQKLAEQFVLLNLVYETTDKHLSPDGQYVPRIMFVDPSLTVRADITGRYSNRLYAYEPADTALCKCDLQFGCCPRVEHLYCCSDGTRGCMVSA

SEQ ID NO: 615 - protein, 163 aa, Homo Sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLCKYSQMISNSGHS

SEQ ID NO: 616 - protein, 166 aa, Homo Sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 617 - protein, 129 aa, Homo Sapiens
  misc_feature (1)..(1): Xaa can be any naturally occurring amino acid
XNIQNTFPTRALAKSGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPL

SEQ ID NO: 618 - protein, 2045 aa, Homo Sapiens
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 619 - protein, 86 aa, Homo Sapiens
MPPLPLARDTRQPPGASLLVRGFMVPCNACLILLATATLGFAVLLFLNNYKPGTHFTPVPPTPPDACRGMLCGFGAVCEPNAEGPG

SEQ ID NO: 620 - protein, 1930 aa, Homo Sapiens
MRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 621 - protein, 287 aa, Homo Sapiens
  misc_feature (1)..(1): Xaa can be any naturally occurring amino acid
XKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNT

SEQ ID NO: 622 - protein, 132 aa, Homo Sapiens
MLTAAVLSCALLLALPATRGAQMGLAPMEGIRRPDQALLPELPGLGLRAPLKKTTAEQAEEDLLQEAQALAEVLDLQDREPRSSRRCVRLHESCLGQQVPCCDPCATCYCRFFNAFCYCRKLGTAMNPCSRT

SEQ ID NO: 623 - protein, 485 aa, Homo Sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 624 - protein, 1278 aa, Homo Sapiens
MRTGSAASSAAAAAAAAAASASPATGVCMKTPGGGRRGIRRDPGAEPGAAALRGPRQRPILSRLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 625 - protein, 1238 aa, Homo Sapiens
MRTGSAASSAAAAAAAAAASASPATGVCMKTPGGGRRGIRRDPGAEPGAAALRGPRQRPILSRLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 626 - protein, 1226 aa, Homo Sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 627 - protein, 1186 aa, Homo Sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 628 - protein, 159 aa, Homo Sapiens
MELPAVNLKCASSSVPRNHPHVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 629 - protein, 111 aa, Homo Sapiens
MELPAVNLKGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 630 - protein, 147 aa, Homo Sapiens
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 631 - protein, 155 aa, Homo Sapiens
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 632 - protein, 155 aa, Homo Sapiens
MELPAVNLKVILLGHWLLTTCFWVACWPPSSWTSCTSASSTRGSASRTRAALAWAWPSSACCSSRSPAASSTTCTGSAGVSSWSTLVSLGLLRTVVPTRRLTQQRRPQIPLQSQRAGVKMPEGTEASHAAPGPAPGLPRAWEVVLGMLLTSVSWT

SEQ ID NO: 633 - protein, 159 aa, Homo Sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 634 - protein, 152 aa, Homo Sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 635 - protein, 63 aa, Homo Sapiens
MELPAVNLKVILLGHWLLTTWHKDCTPCRSWEGDVEVLIRAPQGLPHSEASALQLDFHLYHLF

SEQ ID NO: 636 - protein, 508 aa, Homo Sapiens
MEKWDGNEGTSAFHMPEWMIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 637 - protein, 75 aa, Homo Sapiens
MEKWDGNEGTSAFHMPEWMQIQFADQKQEFNKRPTKIGRRSLSRSISQSSTDSYSSAASYTDSSDDETSPRDKQQ

SEQ ID NO: 638 - protein, 508 aa, Homo Sapiens
MLGSKKKYIVNGNSGIKAQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 639 - protein, 183 aa, Homo Sapiens [sequence omitted]

SEQ ID NO: 640 - protein, 610 aa, Homo Sapiens
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 641 - protein, 611 aa, Homo Sapiens
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 642 - protein, 518 aa, Homo Sapiens
  misc_feature (1)..(1): Xaa can be any naturally occurring amino acid
XRKWSRQFLLSFWCTVCSAHQGTIFLSLKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 643 - protein, 368 aa, Homo Sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPADSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 644 - protein, 367 aa, Homo Sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 645 - protein, 47 aa, Homo Sapiens
MALVPCQVLRMAILLSYCSILCNYKAIEMPSHQTYGGSWKFLTFIDL

SEQ ID NO: 646 - protein, 124 aa, Homo Sapiens
MALVPCQVLRMAILLSYCSILCNYKAIEMPSHQTYGGSWKFLTFIDLFVVAVFWIIYAYDREMIYPKLLDNFIPGWLNHGMHTTVLPFILIEMRTSHHQYPSRSSGLTAICTFSVGYILWVCWV

SEQ ID NO: 647 - protein, 137 aa, Homo Sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHFKA

SEQ ID NO: 648 - protein, 245 aa, Homo Sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKKPPSWQDMKIKFMYLGPSS

SEQ ID NO: 649 - protein, 238 aa, Homo Sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 650 - protein, 231 aa, Homo Sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKTAKLK

SEQ ID NO: 651 - protein, 134 aa, Homo Sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGML

SEQ ID NO: 652 - protein, 138 aa, Homo Sapiens
MLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQK

SEQ ID NO: 653 - protein, 192 aa, Homo Sapiens
MTKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGAR

SEQ ID NO: 654 - protein, 171 aa, Homo Sapiens
MAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 655 - protein, 223 aa, Homo Sapiens
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 656 - protein, 223 aa, Homo Sapiens; identical to SEQ ID NO: 655

SEQ ID NO: 657 - protein, 223 aa, Homo Sapiens; identical to SEQ ID NO: 655

SEQ ID NO: 658 - protein, 78 aa, Homo Sapiens
LALLALLMSLTQGVLTALRLRKMTFGRVSDLGQFIRESEPEPDVRKSKGSMFSQAMKKWVQGNTDEAQEELAWKIAKM

SEQ ID NO: 659 - protein, 138 aa, Homo Sapiens
MRGAGPSPRQSPRTLRPDPGPAMSFFRRKVKGKEQEKTSDVKSIKALKIMPCWRLQDQVMLQSMPFLPTWTPFQVAGQPHLRSSQATWRPLILVTWADLVWTTRLKRPNQAFLRPLNKSCTTLLSSLTSFNSWNFGEW

SEQ ID NO: 660 - protein, 150 aa, Homo Sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLDLVWTTRLKRPNQAFLRPLNKSCTTLLSSLTSFNSWNFGEWSIW

SEQ ID NO: 661 - protein, 662 aa, Homo Sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 662 - protein, 604 aa, Homo Sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 663 - protein, 66 aa, Homo Sapiens
MRGAGPSPRQSPRTLRPDPGPAMSFFRRKVKGKEQEKTSDVKSIKGCRTKSCCNQCHFCQHGLLFK

SEQ ID NO: 664 - protein, 63 aa, Homo Sapiens
MRGAGPSPRQSPRTLRPDPGPAMSFFRRKVKGKEQEKTSDVKSIKVETEFHHVSQYGLDLLTL

SEQ ID NO: 665 - protein, 59 aa, Homo Sapiens
  misc_feature (1)..(1): Xaa can be any naturally occurring amino acid
XKYISPDAAKPIPITEAMRNDIIARICGEDGQVDPNCFVLAQSIVFSAMEQDTWKKRMQ

SEQ ID NO: 666 - protein, 31 aa, Homo Sapiens
  misc_feature (1)..(1): Xaa can be any naturally occurring amino acid
XLTAPGSVGPPDESHPGSSDSSASQCEKSQY

SEQ ID NO: 667 - protein, 323 aa, Homo Sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 668 - protein, 205 aa, Homo Sapiens
MGVVSLFLCIVEQIFTSSKKIQFRGIFMAKVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQPRDNSIFSLSPDW

SEQ ID NO: 669 - protein, 248 aa, Homo Sapiens
  misc_feature (1)..(1): Xaa can be any naturally occurring amino acid
XSKYQCVKLNDGHFMPVLGFGTYAPAEVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNV

SEQ ID NO: 670 - protein, 172 aa, Homo Sapiens
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAFFQESHMCSMCNKRRCHRLYQLGSQSS

SEQ ID NO: 671 - protein, 177 aa, Homo Sapiens
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRGVTHVFHVQQTEMSQTVSTGESIILSCSVPNTLP

SEQ ID NO: 672 - protein, 140 aa, Homo Sapiens
  misc_feature (1)..(1): Xaa can be any naturally occurring amino acid
XLIYNQKEGHFPRVTTVSDLTKRNNMDFSIRISNITPADAGTYYCVKFRKGSPDHVEFKSGAGTELSVREARTVFSARSTESRASPGQAFRQSKLQVSPQCPSLPPHSTHLCLPYCCICCLNWQSLTVLEARSLKSASLD

SEQ ID NO: 673 - protein, 45 aa, Homo Sapiens
  misc_feature (1)..(1): Xaa can be any naturally occurring amino acid
XVHKAVVEVDESGTRAAAATGTIFTFRYSLNGHCVPGTVPSAEEK

SEQ ID NO: 674 - protein, 85 aa, Homo Sapiens
KKEHVFIHERPRKINGICISPKKVACQNLSAIFCFQSETKFKMTVCQLIEGTRYPACRYHYSPTEGFVLVTCDDLRPDSFLGYVK

SEQ ID NO: 675 - protein, 96 aa, Homo Sapiens
MIIMVIIFLVLLFWENEVNDEAVMSTLEHLHVDYPQNDVPVPARRDYTTSEMETFPLLLLSLGLVLAEASESTMKIIKEEFTDEEMQYDMAKSGQE

SEQ ID NO: 676 - protein, 31 aa, Homo Sapiens
MVMGLGVLLLVFVLGLGLTPPTLAQDNSRHL

SEQ ID NO: 677 - protein, 190 aa, Homo Sapiens
MCLCVCLYVCICVYVCVCHFVCFWVCLPLRVSVYLYLRVCVCVCVFVCLCMCVRGCVSVCVCVCIEREGERKGATDGSAWKVYPHSQPWEESVNPPTGQDQLWWCLADSGNVTFHLRMGLHFLGKECRSWSLKECFFFPFVIERAQPCVHWLTVTNLRVGDSHREETEGTADSEQESGGTSLPLGPNPQL

SEQ ID NO: 678 - protein, 23 aa, Homo Sapiens
MSRLVRGSSLLTYLVVALVLQSR

SEQ ID NO: 679 - protein, 1266 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 680 - protein, 1115 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGDHENGTGTNTYAALNSVYLMMNNQMRLLGMETMAWQEIRHAIILLTDGKSNMGGSPKTAVDHIREILNINQKRNDYLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGGSAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 681 - protein, 175 aa, Homo Sapiens
MGHEQNQGAALLQMLPLLWLLPHSWAVPEEQSMITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPA

SEQ ID NO: 682 - protein, 63 aa, Homo Sapiens
MGTSSIFLCVLFLCGALGLTMSPARGRLRCYICGFTKPCHPVPTECRDDEACGISIGTSDAHC

SEQ ID NO: 683 - protein, 33 aa, Homo Sapiens
  misc_feature (1)..(1): Xaa can be any naturally occurring amino acid
XLGLTYLSLLLIPAAGASSCPRTPLPAMAPLPQ

SEQ ID NO: 684 - protein, 198 aa, Homo Sapiens
MLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLA

SEQ ID NO: 685 - protein, 171 aa, Homo Sapiens
MLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYS

SEQ ID NO: 686 - protein, 165 aa, Homo Sapiens
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNY

SEQ ID NO: 687 - protein, 574 aa, Homo Sapiens
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 688 - protein, 587 aa, Homo Sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 689 - protein, 550 aa, Homo Sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 690 - protein, 141 aa, Homo Sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGRPCSVMVLELVAPATSQAPILPGCEIYSDAGNHASMIQG

SEQ ID NO: 691 - protein, 276 aa, Homo Sapiens
  misc_feature (1)..(1): Xaa can be any naturally occurring amino acid
XELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRRSCCWLGLRWGCPSRMCLWLPAISVAVLYTLSS

SEQ ID NO: 692 - protein, 197 aa, Homo Sapiens
GFEWGGQRRASHNSTFSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQA

SEQ ID NO: 693 - protein, 417 aa, Homo Sapiens
MKWVTFISLLFLFSSAYSRGVFRRDAHKSEVAHRFKDLGEENFKALAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 694 - protein, 609 aa, Homo Sapiens [sequence omitted]

SEQ ID NO: 695 - protein, 604 aa, Homo Sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEPTMRIRERK

SEQ ID NO: 696 - protein, 396 aa, Homo Sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 697 - protein, 396 aa, Homo Sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 698 - protein, 494 aa, Homo Sapiens
MKWVTFISLLFLFSSAYSRGVFRRDAHKSEVAHRFKDLGEENFKALYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 699 - protein, 105 aa, Homo Sapiens
MKWVTFISLLFLFSSAYSRGVFRRDAHTYMKLPEDILTFMPRNSFSLLKGIKLLLQNVAKLLIKLPACCQSSMNFGMKGRLRLPNRDSSVPVSKNLEKELSKHGQ

SEQ ID NO: 700 - protein, 459 aa, Homo Sapiens
MSQLKIVTNHLYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 701 - protein, 454 aa, Homo Sapiens
  misc_feature (1)..(1): Xaa can be any naturally occurring amino acid
XFSKFRYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 702 - protein, 518 aa, Homo Sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 703 - protein, 418 aa, Homo Sapiens
MARRKPEGSSFNMTHLSMAMAFSFPPVASGQLHPQLGNTQHQTELGKELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 704 - protein, 278 aa, Homo Sapiens
MARRKPEGSSFNMTHLSMAMAFSFPPVASGQLHPQLGNTQHQTELGKELATTSTMPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYL

SEQ ID NO: 705 - protein, 418 aa, Homo Sapiens; identical to SEQ ID NO: 703

SEQ ID NO: 706 - protein, 155 aa, Homo Sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIG

SEQ ID NO: 707 - protein, 364 aa, Homo Sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 708 - protein, 364 aa, Homo Sapiens; identical to SEQ ID NO: 707

SEQ ID NO: 709 - protein, 364 aa, Homo Sapiens; identical to SEQ ID NO: 707

SEQ ID NO: 710 - protein, 364 aa, Homo Sapiens; identical to SEQ ID NO: 707

SEQ ID NO: 711 - protein, 361 aa, Homo Sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALVRIGRRWAGCLGGWDSEKSPSHSTPLPA

SEQ ID NO: 712 - protein, 364 aa, Homo Sapiens; identical to SEQ ID NO: 707

SEQ ID NO: 713 - protein, 368 aa, Homo Sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVGLQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 714 - protein, 140 aa, Homo Sapiens
MPYQYPALTPEQKKELSDIAHRIVAPGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCV

SEQ ID NO: 715 - protein, 162 aa, Homo Sapiens
MPYQYPALTPEQKKELSDIAHRIVAPGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLAR

SEQ ID NO: 716 - protein, 204 aa, Homo Sapiens
RRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVLAAVYKALSDHHIYLEGTLLKPNMVTPGHACTQKFSHEEIAMATVTALRRTVPPAVTGITFLSGGQSEEEASINLNAI

SEQ ID NO: 717 - protein, 130 aa, Homo Sapiens
  misc_feature (1)..(1): Xaa can be any naturally occurring amino acid
XPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 718 - protein, 464 aa, Homo Sapiens
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 719 - protein, 184 aa, Homo Sapiens
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQVCLALLSAGSWAAFVEASSSLTGTTMATPSWVWCMAPTIPSFCWPSGTRSSLGA

SEQ ID NO: 720 - protein, 84 aa, Homo Sapiens
MAASCLVLLALCLLLPLLLLGGWKRWRRGRAARHVVAVVLGDVGRSPRMQYHALSLAMHGFSVTLLGFCSEWPRVWEGRCSLSR

SEQ ID NO: 721 - protein, 168 aa, Homo Sapiens
MYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPAL

SEQ ID NO: 722 - protein, 353 aa, Homo Sapiens
MYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 723 - protein, 353 aa, Homo Sapiens; identical to SEQ ID NO: 722

SEQ ID NO: 724 - protein, 324 aa, Homo Sapiens
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 725 - protein, 294 aa, Homo Sapiens
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 726 - protein, 102 aa, Homo Sapiens
MASRGARQRLKGSGASSGDTAPAADKLRELLGSREAGGAEHRTEHTTSSMGKGFRLGNIPQHMPFAPMLTCCFMPGQLHFMQEFYKLIRFLCFTFCDVFWLL

SEQ ID NO: 727 - protein, 168 aa, Homo Sapiens
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKGCVQEVWVARESNDASLLGSQHWHVLLIISIPS

SEQ ID NO: 728 - protein, 618 aa, Homo Sapiens
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 729 - protein, 611 aa, Homo Sapiens
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 730 - protein, 198 aa, Homo Sapiens
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSVYPLPLICWS

SEQ ID NO: 731 - protein, 134 aa, Homo Sapiens
MASRGARQRLKGSGASSGDTAPAADKLRELLGSREAGGAEHRTELSGNKAGQVWAPEGSTAFKCLLSARLCAALLSNISDCDETFNYWEPVDTLPHLWGRVSDLGIFPSICHSLLCLPVASCLASCISCKNSTN

SEQ ID NO: 732 - protein, 447 aa, Homo Sapiens
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 733 - protein, 440 aa, Homo Sapiens
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 734 - protein, 24 aa, Homo Sapiens
  misc_feature (1)..(1): Xaa can be any naturally occurring amino acid
XEEWISLAYRPFLDASRVSLCCPG

SEQ ID NO: 735 - protein, 35 aa, Homo Sapiens
  misc_feature (1)..(1): Xaa can be any naturally occurring amino acid
XKYSSNKEEWISLAYRPFLDASSFEGWKTKITMPV

SEQ ID NO: 736 - protein, 207 aa, Homo Sapiens
  misc_feature (1)..(1): Xaa can be any naturally occurring amino acid
XTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGDRRRAEPTYRKN

SEQ ID NO: 737 - protein, 111 aa, Homo Sapiens
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYIS

SEQ ID NO: 738 - protein, 129 aa, Homo Sapiens
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYYKRCARLLTRLAVSPLCSQT

SEQ ID NO: 739 - protein, 59 aa, Homo Sapiens
MKDKFLKHLTGPLYFSPKCSKHFHRLYHNTRDCTIPAYYKRCARLLTRLAVSPVCMEDK

SEQ ID NO: 740 - protein, 59 aa, Homo Sapiens; identical to SEQ ID NO: 739

SEQ ID NO: 741 - protein, 60 aa, Homo Sapiens
MKDKFLKHLTGPLYFSPKCSKHFHRLYHNTRDCTIPAYYKRCARLLTRLAVSPVCMEDKQ

SEQ ID NO: 742 - protein, 151 aa, Homo Sapiens
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDK

SEQ ID NO: 743 - protein, 152 aa, Homo Sapiens
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDKQ

SEQ ID NO: 744 - protein, 91 aa, Homo Sapiens
MRGPGHPLLLGLLLVLGPSPEQRVEIVPRDLRMKDKFLKHLTGPLYFSPKCSKHFHRLYHNTRDCTIPAYYKRCARLLTRLAVSPVCMEDK

SEQ ID NO: 745 - protein, 102 aa, Homo Sapiens
  misc_feature (1)..(1): Xaa can be any naturally occurring amino acid
XHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDK

SEQ ID NO: 746 - protein, 112 aa, Homo Sapiens
AAAVGSVATLATEPGEDAFRKLFRFYRQSRPGTADLEGVIDFSAAHAARGKGPGAQKVIKSQLNVSSVSEQNAYRAGLQPVSKWQAYGLKGYPGIKKRLNGDPEVYWRNCVG

SEQ ID NO: 747 - protein, 389 aa, Homo Sapiens
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 748 - protein, 116 aa, Homo Sapiens
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGIKKRLNGDPEVYWRNCVG

SEQ ID NO: 749 - protein, 394 aa, Homo Sapiens
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 750 - protein, 53 aa, Homo Sapiens
MDKEENRRSVLLPTHRRRGSFSSENYWRKSYESSEDCSEAAGSPARKVKMRRH

SEQ ID NO: 751 - protein, 528 aa, Homo Sapiens
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 752 - protein, 50 aa, Homo Sapiens
MQGPWVLLLLGLRLQLSLGVIPGNEAPQAVPHTGHPLSQADLISTLPLAS

SEQ ID NO: 753 - protein, 469 aa, Homo Sapiens
MFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 754 - protein, 524 aa, Homo Sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 755 - protein, 524 aa, Homo Sapiens; identical to SEQ ID NO: 754

SEQ ID NO: 756 - protein, 447 aa, Homo Sapiens
MPWSFRSSTPTWLRMSSCSWEMTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 757 - protein, 216 aa, Homo Sapiens
  misc_feature (1)..(1): Xaa can be any naturally occurring amino acid
XHSHFIWNRTELLTLDPHNVDYLLGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 758 - protein, 535 aa, Homo Sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 759 - protein, 532 aa, Homo Sapiens
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 760 - protein, 432 aa, Homo Sapiens
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 761 - protein, 447 aa, Homo Sapiens
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 762 - protein, 446 aa, Homo Sapiens [sequence omitted]

SEQ ID NO: 763 - protein, 193 aa, Homo Sapiens
HKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTVRGPCRAFIQLWAFDAVKGKCVLFPYGGC

SEQ ID NO: 764 - protein, 352 aa, Homo Sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 765 - protein, 238 aa, Homo Sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRVNGLEQATQAGPFMKWTKARQVPSTMLTKDTNPGLGWPLGLVLLFTPLSCSVT

SEQ ID NO: 766 - protein, 205 aa, Homo Sapiens
MGTWILFACLLGAAFAMPLPPHPGHPGYINFSYENSHSQAINVDRTALVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 767 - protein, 191 aa, Homo Sapiens
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 768 - protein, 175 aa, Homo Sapiens
MGTWILFACLLGAAFAMPVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 769 - protein, 206 aa, Homo Sapiens
MGTWILFACLVGAAFAMPLPPHPGHPGYINFSYENSHSQAINVDRIALVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 770 - protein, 192 aa, Homo Sapiens
MGTWILFACLVGAAFAMPLPPHPGHPGYINFSYEVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 771 - protein, 560 aa, Homo Sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQVRGAALARPPCCVPTAYAGKLLISLSEERISAHHVPNMVATECGCR

SEQ ID NO: 772 - protein, 780 aa, Homo Sapiens
MNVRIFYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 773 - protein, 776 aa, Homo Sapiens
MNVRIFYSVSQSPHSLLSLLFYCAILESRISATMPLFKLPEIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 774 - protein, 191 aa, Homo Sapiens
QCLCSNSQVGVQKIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVRPIPTGA

SEQ ID NO: 775 - protein, 208 aa, Homo Sapiens
MRSTILLFCLLGSTRSLPLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 776 - protein, 209 aa, Homo Sapiens
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 777 - protein, 105 aa, Homo Sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVG

SEQ ID NO: 778 - protein, 226 aa, Homo Sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAIL

SEQ ID NO: 779 - protein, 511 aa, Homo Sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 780 - protein, 105 aa, Homo Sapiens; identical to SEQ ID NO: 777

SEQ ID NO: 781 - protein, 226 aa, Homo Sapiens; identical to SEQ ID NO: 778

SEQ ID NO: 782 - protein, 511 aa, Homo Sapiens; identical to SEQ ID NO: 779

SEQ ID NO: 783 - protein, 511 aa, Homo Sapiens; identical to SEQ ID NO: 779

SEQ ID NO: 784 - protein, 511 aa, Homo Sapiens; identical to SEQ ID NO: 779

SEQ ID NO: 785 - protein, 511 aa, Homo Sapiens
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 786 - protein, 511 aa, Homo Sapiens; identical to SEQ ID NO: 785

SEQ ID NO: 787 - protein, 209 aa, Homo Sapiens
  misc_feature (1)..(1): Xaa can be any naturally occurring amino acid
XFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVIDLGGEPIKSSDYFGNGRVTEFKYGAKLGTVIRKWNGE

SEQ ID NO: 788 - protein, 86 aa, Homo Sapiens
MKFFLLLFTIGFCWAQYSPNTQQGRTSIVHLFEWRWVDIALECERYLAPKGFGGVQVSPPNENVAIHNPFRPWWERYQPVSYKLCT

SEQ ID NO: 789 - protein, 96 aa, Homo Sapiens
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRN

SEQ ID NO: 790 - protein, 511 aa, Homo Sapiens
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 791 - protein, 370 aa, Homo Sapiens
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNEHG

SEQ ID NO: 792 - protein, 511 aa, Homo Sapiens; identical to SEQ ID NO: 790

SEQ ID NO: 793 - protein, 147 aa, Homo Sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 794 - protein, 147 aa, Homo Sapiens; identical to SEQ ID NO: 793

SEQ ID NO: 795 - protein, 129 aa, Homo Sapiens
MAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWE

SEQ ID NO: 796 - protein, 67 aa, Homo Sapiens
MEGVTDTKPERPAGWAESVLEEDASELEPAFSRTVGTIQHCLHLTSVYTHFLPQRGRPEVTTMPLGL

SEQ ID NO: 797 - protein, 670 aa, Homo Sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 798 - protein, 235 aa, Homo Sapiens
MSQNMGCYFLFLSWFPYSHPSFSTQVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 799 - protein, 298 aa, Homo Sapiens
MEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 800 - protein, 297 aa, Homo Sapiens
MEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 801 - protein, 30 aa, Homo Sapiens
MKSEMAQIQQNAVQNHTATMLEIGTSLLSQ

SEQ ID NO: 802 - protein, 497 aa, Homo Sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 803 - protein, 498 aa, Homo Sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 804 - protein, 496 aa, Homo Sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 805 - protein, 459 aa, Homo Sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGRDDFLSSYLYWQGMIS

SEQ ID NO: 806 - protein, 495 aa, Homo Sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 807 - protein, 444 aa, Homo Sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 808 - protein, 503 aa, Homo Sapiens
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 809 - protein, 114 aa, Homo Sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVN

SEQ ID NO: 810 - protein, 491 aa, Homo Sapiens
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 811 - protein, 491 aa, Homo Sapiens; identical to SEQ ID NO: 810

SEQ ID NO: 812 - protein, 191 aa, Homo Sapiens
MQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 813 - protein, 493 aa, Homo Sapiens
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 814 - protein, 460 aa, Homo Sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 815 - protein, 86 aa, Homo Sapiens
MSGAPTAGAALMLCAATAVLLSAQGGPVQSKSPRFASWDEMNVLAHGLLQLGQGLREHAERTRSQLSALERRLSACGSACQGTEGS

SEQ ID NO: 816 - protein, 96 aa, Homo Sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESR

SEQ ID NO: 817 - protein, 105 aa, Homo Sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSL

SEQ ID NO: 818 - protein, 368 aa, Homo Sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHHGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 819 - protein, 406 aa, Homo Sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 820 - protein, 406 aa, Homo Sapiens; identical to SEQ ID NO: 819

SEQ ID NO: 821 - protein, 128 aa, Homo Sapiens
MSGAPTAGAALMLCAATAVLLSAQGGPVQSKSPRFASWDEMNVLAHGLLQLGQGLREHAERTRSQLSALERRLSACGSFTACRHNSRLRTAGSSNSSTRWPSSSGTWRSSTCEFSICKASLASWTTST

SEQ ID NO: 822 - protein, 129 aa, Homo Sapiens
  misc_feature (1)..(1): Xaa can be any naturally occurring amino acid
XPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQTGLNGGLSHID

SEQ ID NO: 823 - protein, 192 aa, Homo Sapiens
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVMCDMDYRGGGRTVIQKRIDGIIDFQRLWCDYLDGFGDLLGEFWLGLKKIFYIVNQKNTSFMLYVALESEDDTLAYA

SEQ ID NO: 824 - protein, 388 aa, Homo Sapiens
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVNELMNRVLLLTTEVFRKQLDPFPHRPVQSHGLDCTDIKDTIGSVTKTPSGLYIIHPEGSSYPFEVMCDMDYRGGGRTVIQKRIDGIIDFQRLWCDYLDGFGDLLGEFWLGLKKIFYIVNQKNTSFMLYVALESEDDTLAYASYDNFWLEDETRFFKMHLGRYSGNAGDAFRGLKKEDNQNAMPFSTSDVDNDGCRPACLVNGQSVKSCSHLHNKTGWWFNECGLANLNGIHHFSGKLLATGIQWGTWTKNNSPVKIKSVSMKIRRMYNPYFK

SEQ ID NO: 825 - protein, 470 aa, Homo Sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 826 - protein, 470 aa, Homo Sapiens; identical to SEQ ID NO: 825

SEQ ID NO: 827 - protein, 430 aa, Homo Sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 828 - protein, 346 aa, Homo Sapiens
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 829 - protein, 99 aa, Homo Sapiens
MEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 830 - protein, 198 aa, Homo Sapiens
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 831 - protein, 198 aa, Homo Sapiens; identical to SEQ ID NO: 830

SEQ ID NO: 832 - protein, 58 aa, Homo Sapiens
  misc_feature (1)..(1): Xaa can be any naturally occurring amino acid
XAQELRASLLETQAHADKQSHILWALTGHVQRQRREMVAQQHRLRQIQERLHTAALPA

SEQ ID NO: 833 - protein, 1897 aa, Homo Sapiens
MAQAAKQLKKIKDIEAQALQEQKEKEESNRKRRNRSRDRKKKADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGTAHITIMGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEDHTSTPNP

SEQ ID NO: 834 - protein, 1880 aa, Homo Sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 835 - protein, 1881 aa, Homo Sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 836 - protein, 109 aa, Homo Sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKDHTSTPNP

SEQ ID NO: 837 - protein, 131 aa, Homo Sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEDHTSTPNP

SEQ ID NO: 838 - protein, 155 aa, Homo Sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 839 - protein, 156 aa, Homo Sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 840 - protein, 113 aa, Homo Sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKVELRGSGLQPDL

SEQ ID NO: 841 - protein, 177 aa, Homo Sapiens
  misc_feature (1)..(1): Xaa can be any naturally occurring amino acid
XEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGGRSEVRREAARF

SEQ ID NO: 842 - protein, 1040 aa, Homo Sapiens
  misc_feature (1)..(1): Xaa can be any naturally occurring amino acid
XIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGTAHITIMGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 843 - protein, 553 aa, Homo Sapiens
  misc_feature (1)..(1): Xaa can be any naturally occurring amino acid
XTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 844 - protein, 133 aa, Homo Sapiens
IGRRVNTRARNHVGRVALHWAAGAGHEQAVRLLLEHEAAVDEEDAVGALTEEGNTALHLAAGRGHMAVLQRLVDIGLDLEEQNAEGLTALHSAAGGSHPDCVQLLLRAGSTVNALTQVARPSQDCGRLLAAEP

SEQ ID NO: 845 - protein, 423 aa, Homo Sapiens
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAENIRKKANAAPSAPRRCTAM

SEQ ID NO: 846 - protein, 399 aa, Homo Sapiens
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 847 - protein, 423 aa, Homo Sapiens; identical to SEQ ID NO: 845

SEQ ID NO: 848 - protein, 181 aa, Homo Sapiens
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQVARPSQDCGRLLAAEP

SEQ ID NO: 849 - protein, 123 aa, Homo Sapiens
MQEELAWETDGLLPLERQLHEAARQNNVGRMQELIGRRVNTRARNHVGRVALHWAAGAGHEQAVRLLLEHEAAVDEEDAFGMNALLLSAWFGHLRILQILVNSGAKIHCESKPKKAMCLCWRS

SEQ ID NO: 850 - protein, 522 aa, Homo Sapiens
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 851 - protein, 217 aa, Homo Sapiens [sequence omitted]

SEQ ID NO: 852 - protein, 300 aa, Homo Sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 853 - protein, 284 aa, Homo Sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 854 - protein, 90 aa, Homo Sapiens
MARIPVQLMTRAAQLYTLPHAMAMTRLLLLDHGADPNQRDGLGNTPLHLAACTNHVPVITTLLRGGARVDALDRAGRTPLHLAKSKLNIL

SEQ ID NO: 855 - protein, 156 aa, Homo Sapiens
MARIPVQLMTRAAQLYTLPHAMAMTRLLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTS

SEQ ID NO: 856 - protein, 107 aa, Homo Sapiens
MPMMWKQCSCSWTMVLILTSEMGWGTRHCTWRPAPTTFLSSPHCYEEIIHMLREYLERLGQHEQRERLDDLCTRLQMTSTKEQVDEVTDLLASFTSLSLQMQSMEKR

SEQ ID NO: 857 - protein, 180 aa, Homo Sapiens
MPMMWKQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 858 - protein, 208 aa, Homo Sapiens
  misc_feature (1)..(1): Xaa can be any naturally occurring amino acid
XRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLECSPQLVPAGARVDALDRAGRTPLHLAKSKLNILQEGHAQCLEAVRLEVKQIIHMLREYLERLGQHEQRERLDDLCTRLQMTSTKEQVDEVTDLLASFTSLSL

SEQ ID NO: 859 - protein, 178 aa, Homo Sapiens
  misc_feature (1)..(1): Xaa can be any naturally occurring amino acid
XRLRRPGPRGAVAMAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIAAPGPWC

SEQ ID NO: 860 - protein, 345 aa, Homo Sapiens
MTRGRAWGMRRAAAGAGGARAAGPTGGASRLHPNAGRRSGARAGAQGCGGPRVGSADSRALPAQPLACARGRSQRLVCDPKAASALPDLAPDVFVLRVRLEETGEMFRVANCRGDMTVRELKEELDLMVGIPFNLQRLQYLDEGVLMDDTTLKFHDVVPGGIISLCIWHHDGWTELVLAAVEGDPSKLSCLGLTEDSFYRTANSEHFEGEKWKHWTSQRAFVALYVASHRGHFDAVQYLLEHGASCLSRSPLGRTPLHVAAAMGRSDCIILLLQHGASIHDRDAKGETPISIAHRLNHTLSERQMVLLHRIAKSGIRDLNDLVMKNALQRVKSGFRSEKMTMTPH

SEQ ID NO: 861 - protein, 933 aa, Homo Sapiens
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 862 - protein, 883 aa, Homo Sapiens
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEVAEAPAGSPIHGMRPRPCALPNSSTW

SEQ ID NO: 863 - protein, 179 aa, Homo Sapiens
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQVRGGCHGQGPRPCIHSVTHDLAA

SEQ ID NO: 864 - protein, 186 aa, Homo Sapiens
  misc_feature (1)..(1): Xaa can be any naturally occurring amino acid
XAGGAFRGLRADGGGEPGRDPLPAVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVP

SEQ ID NO: 865 - protein, 680 aa, Homo Sapiens
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 866 - protein, 564 aa, Homo Sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 867 - protein, 333 aa, Homo Sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSLHKIASGPTTAACME

SEQ ID NO: 868 - protein, 368 aa, Homo Sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEENKIK

SEQ ID NO: 869 - protein, 179 aa, Homo Sapiens
  misc_feature (1)..(1): Xaa can be any naturally occurring amino acid
XDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCDGLWFYIQSLETVKDHRNIRVRNSDLKYCL

SEQ ID NO: 870 - protein, 52 aa, Homo Sapiens
MQSPWKILTVAPLFLLLSLQSSASPANDDQSRPSLSNGHTCVASSAEKPQLS

SEQ ID NO: 871 - protein, 108 aa, Homo Sapiens
MQSPWKILTVAPLFLLLSLQSSASPANDDQSRPSLSNGHTCVEKLFLKTTCYLVIDKFGSDIIKLLSADMNADVVCHTLEFCKQNTGQPLCHLYPLPKETWKFTLQKA

SEQ ID NO: 872 - protein, 543 aa, Homo Sapiens
MQSPWKILTVAPLFLLLSLQSSASPANDDQSRPSLSNGHTCVEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 873 - protein, 688 aa, Homo Sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNERKSILLKGILMTSQTLDNQEWTQLTSWIKGNLTCDSRTREWLCCCWRIISGKRCSSSGPKSWERRIRSTPRLNRCLETKAGTEPLRSMHPWGAQGGRGLGKLIPQTLWGLPRHRPKGLFFSSIFAKCLSLNEEHIWTTVQCCVLPGSVTLPLFLK

SEQ ID NO: 874 - protein, 575 aa, Homo Sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 875 - protein, 249 aa, Homo Sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEEL

SEQ ID NO: 876 - protein, 751 aa, Homo Sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 877 - protein, 770 aa, Homo Sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARTEGGQPRALSQAASPVPGRYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 878 - protein, 751 aa, Homo Sapiens; identical to SEQ ID NO: 876

SEQ ID NO: 879 - protein, 337 aa, Homo Sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVL

SEQ ID NO: 880 - protein, 751 aa, Homo Sapiens; identical to SEQ ID NO: 876

SEQ ID NO: 881 - protein, 756 aa, Homo Sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIHIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 882 - protein, 729 aa, Homo Sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 883 - protein, 763 aa, Homo Sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 884 - protein, 634 aa, Homo Sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERIWWPG

SEQ ID NO: 885 - protein, 112 aa, Homo Sapiens
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWA

SEQ ID NO: 886 - protein, 152 aa, Homo Sapiens
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTV

SEQ ID NO: 887 - protein, 220 aa, Homo Sapiens
MVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 888 - protein, 220 aa, Homo Sapiens; identical to SEQ ID NO: 887

SEQ ID NO: 889 - protein, 144 aa, Homo Sapiens
  misc_feature (1)..(1): Xaa can be any naturally occurring amino acid
XYDYVWDTVFHPSGAIEIRFYATGYISSAFLFGATGKYGNQVSEHTLGTVHTHSAHFKVDLDVAGDPEAAGDGGAGRLPRGKRHPSLPVPGQQPQQQVGSPPGLPHPDAQLCWRAAAPKQLHGERLQLGEVPAGCDPAEGGGAQ

SEQ ID NO: 890 - protein, 164 aa, Homo Sapiens
MSVLTPLLLRGLTGSARRLPVPRAKIHSLPPEGKLGIMGKENGIGSRRICNHHRELWEAGKMEPNQCVGWRCGSGAAGLSYRSQVRRPGVPAPATGLEAHSLTTPKGIPLLGLLPRRGNEEGLASGRTAIGNPEAVGSAALFKDGGGGTSAAEAGAAGQRLRRC

SEQ ID NO: 891 - protein, 235 aa, Homo Sapiens
MLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 892 - protein, 87 aa, Homo Sapiens
MRVQDTSGTYYWHIPTGTTQWEPPGRASPSQGSSPQEESQLTWTGFAHGEGFEDGEFWKDEPSDEAPMELGLKEPEEGTLTFPAQSL

SEQ ID NO: 893 - protein, 262 aa, Homo Sapiens
MRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKL

SEQ ID NO: 894 - protein, 451 aa, Homo Sapiens
MRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 895 - protein, 451 aa, Homo Sapiens; identical to SEQ ID NO: 894

SEQ ID NO: 896 - protein, 451 aa, Homo Sapiens; identical to SEQ ID NO: 894

SEQ ID NO: 897 - protein, 451 aa, Homo Sapiens [sequence omitted]

SEQ ID NO: 898 - protein, 451 aa, Homo Sapiens [sequence omitted]

SEQ ID NO: 899 - protein, 488 aa, Homo Sapiens
MSAMFSQDFFLAIILQDSSADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 900 - protein, 490 aa, Homo Sapiens
MSAMFSQDFFLAIILQDSSADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 901 - protein, 708 aa, Homo Sapiens
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902 - protein, 708 aa, Homo Sapiens; identical to SEQ ID NO: 901

SEQ ID NO: 903 - protein, 710 aa, Homo Sapiens [sequence omitted]

SEQ ID NO: 904 - protein, 710 aa, Homo Sapiens
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 905 - protein, 707 aa, Homo Sapiens
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMVEQEELVQARPHPPGPSRGRRRKGLVQAWVPSPCSMGTSAVLISLIKSVCTA

SEQ ID NO: 906 - protein, 475 aa, Homo Sapiens
MTQMRDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 907 - protein, 475 aa, Homo Sapiens [sequence omitted]

SEQ ID NO: 908 - protein, 22 aa, Homo Sapiens
MSWPRRLLLRYLFPALLLHAVK

SEQ ID NO: 909 - protein, 61 aa, Homo Sapiens
MSWPRRLLLRYLFPALLLHEPRPCLHRLSDHLSVRRAPPSHPAPKGRPDHRPARGVGEPAL

SEQ ID NO: 910 - protein, 184 aa, Homo Sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQGHGRHRVRVQSESHEGHPHGCGHSLTAQRLQRE

SEQ ID NO: 911 - protein, 514 aa, Homo Sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 912 - protein, 94 aa, Homo Sapiens
PEDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 913 - protein, 227 aa, Homo Sapiens
  misc_feature (1)..(1): Xaa can be any naturally occurring amino acid
XDVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 914 - protein, 223 aa, Homo Sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 915 - protein, 54 aa, Homo Sapiens
MRFQQFLFAFFIFIMSLLLISGQRPVNLTMRRKLRKHNCLQRRCMPLHSRVPFP

SEQ ID NO: 916 - protein, 54 aa, Homo Sapiens; identical to SEQ ID NO: 915

SEQ ID NO: 917 - protein, 54 aa, Homo Sapiens; identical to SEQ ID NO: 915

SEQ ID NO: 918 - protein, 77 aa, Homo Sapiens
MNLRLCVQALLLLWLSLTAVCGGSLMPLPDGNGLEDGNVRHLVQPRGSRNGPGPWQGGRRKFRRQRPRLSHKGPMPF

SEQ ID NO: 919 - protein, 158 aa, Homo Sapiens
MAATGTAAAAATGRLLLLLLALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEV

SEQ ID NO: 920 - protein, 35 aa, Homo Sapiens
MAATGTAAAAATGRLLLLLLVGLTAPALALAGYIE

SEQ ID NO: 921 - protein, 116 aa, Homo Sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNSGWRCVRITSTGTR

SEQ ID NO: 922 - protein, 763 aa, Homo Sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 923 - protein, 751 aa, Homo Sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 924 - protein, 695 aa, Homo Sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 925 - protein, 522 aa, Homo Sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 926 - protein, 159 aa, Homo Sapiens [sequence omitted]

SEQ ID NO: 927 - protein, 39 aa, Homo Sapiens
MAATGTAAAAATGRLLLLLLVGLTAPALALAGYIEWVNL

SEQ ID NO: 928 - protein, 761 aa, Homo Sapiens
MLRAPGELPRQAARCSLCRLGPGRGRAFFKWRCLPASVDRGNPLWALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 929 - protein, 267 aa, Homo Sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 930 - protein, 267 aa, Homo Sapiens; identical to SEQ ID NO: 929

SEQ ID NO: 931 - protein, 267 aa, Homo Sapiens; identical to SEQ ID NO: 929

SEQ ID NO: 932 - protein, 267 aa, Homo Sapiens; identical to SEQ ID NO: 929

SEQ ID NO: 933 - protein, 245 aa, Homo Sapiens
MSGGARGFCMLKAPHSARPFFSSRSPTALQDESCGADLGRALPDGLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 934 - protein, 133 aa, Homo Sapiens
MCEQHPKRPGLQLWRGREPGWNGQQAALPTVTNMKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 935 - protein, 52 aa, Homo Sapiens
MEKVKSPELQAEAKSYFEKSKEQLTPLIKKAGTELVNFLSYFVELGTQPATQ

SEQ ID NO: 936 - protein, 52 aa, Homo Sapiens; identical to SEQ ID NO: 935

SEQ ID NO: 937 - protein, 66 aa, Homo Sapiens
MKLLAATVLLLTICSLEGALVRRQAKEPCVESLVSQYFQTVTDYGKDLMEKVKSPELQAEAKSYFE

SEQ ID NO: 938 - protein, 95 aa, Homo Sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGT

SEQ ID NO: 939 - protein, 100 aa, Homo Sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 940 - protein, 82 aa, Homo Sapiens
MKLLAATVLLLTICSLEGALVRRQAKEPCVESLVSQYFQTVTDYGKDLMEKVKSPELQAEAKSYFENFLSYFVELGTQPATQ

SEQ ID NO: 941 - protein, 72 aa, Homo Sapiens
MKLLAATVLLLTICSLEGLATKGLKRKIIPSLKPRKPIQRSGWIPFWGGGRELGWVLAEVWQEARIHCCGPS

SEQ ID NO: 942 - protein, 27 aa, Homo Sapiens
MKLLAATVLLLTICSLEGLTLKSQRSS

SEQ ID NO: 943 - protein, 396 aa, Homo Sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 944 - protein, 162 aa, Homo Sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQL

SEQ ID NO: 945 - protein, 366 aa, Homo Sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 946 - protein, 366 aa, Homo Sapiens; identical to SEQ ID NO: 945

SEQ ID NO: 947 - protein, 4563 aa, Homo Sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 948 - protein, 828 aa, Homo Sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMDRPDSLTIPAAQARKDACTFFRDGGLP

SEQ ID NO: 949 - protein, 54 aa, Homo Sapiens
MRLFLSLPVLVVVLSIVLEGPAPAQGTPDVSSALDKLKEFGNTLEDKARELISR

SEQ ID NO: 950 - protein, 83 aa, Homo Sapiens
MRLFLSLPVLVVVLSIVLEGPAPAQGTPDVSSALDKLKEFGNTLEDKARELISRIKQSELSAKMREDDISPCCPGWSRTPDLK

SEQ ID NO: 951 - protein, 77 aa, Homo Sapiens
MRLFLSLPVLVVVLSIVLEGPAPAQGTPDVSSALDKLKEFGNTLEDKARELISRIKQSELSAKMREWFSETFQKVKE

SEQ ID NO: 952 - protein, 83 aa, Homo Sapiens
MRLFLSLPVLVVVLSIVLEGPAPAQGTPDVSSALDKLKEFGNTLEDKARELISRIKQSELSAKMREWFSETFQKVKEKLKIDS

SEQ ID NO: 953 - protein, 83 aa, Homo Sapiens; identical to SEQ ID NO: 952

SEQ ID NO: 954 - protein, 92 aa, Homo Sapiens
MRLFLSLPVLVVVLSIVLEGPAPAQGTPDVSSALDKLKEFGNTLEDKARELISRIKQSELSAKMRLEPFPGHGRAGGVVFRDISESEGETQD

SEQ ID NO: 955 - protein, 129 aa, Homo Sapiens
MRLFLSLPVLVVVLSIVLEGPAPAQGTPDVSSALDKLKEFGNTLEDKARELISRIKQSELSAKMRLEPFPGHGRAGVCFWVEPWQMVQDEQIEKKTSPGEADNIPLVTQLDLKGVVFRDISESEGETQD

SEQ ID NO: 956 - protein, 29 aa, Homo Sapiens
MRLFLSLPVLVVVLSIVLEGSGFQRHFRK

SEQ ID NO: 957 - protein, 39 aa, Homo Sapiens
MRLFLSLPVLVVVLSIVLEGSPRLSPAGAKSAQESTSNR

SEQ ID NO: 958 - protein, 87 aa, Homo Sapiens
MGTRLLPALFLVLLVLGFEVQGTQQPQQDEMPSPTFLTQVKESLSSYWESAKTAAQNLDLYSKSTAAMSTYTGIFTDQVLSVLKGEE

SEQ ID NO: 959 - protein, 72 aa, Homo Sapiens
MGTRLLPALFLVLLVLGFEVQGTQQPQQDEMPSPTFLTQVKESLSSYWESAKTAAQNLYEKTYLPAVDEKLR

SEQ ID NO: 960 - protein, 101 aa, Homo Sapiens
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 961 - protein, 101 aa, Homo Sapiens; identical to SEQ ID NO: 960

SEQ ID NO: 962 - protein, 47 aa, Homo Sapiens
MGTRLLPALFLVLLVLGFGEGISLQLLGVSKDSRPEPVREDIPARCR

SEQ ID NO: 963 - protein, 117 aa, Homo Sapiens
MGTWGAPHRTLPCRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 964 - protein, 117 aa, Homo Sapiens; identical to SEQ ID NO: 963

SEQ ID NO: 965 - protein, 55 aa, Homo Sapiens
MQPRVLLVVALLALLASARASEAEDASLLSFMQGYMKHATKTAKDALSSVQESQV

SEQ ID NO: 966 - protein, 99 aa, Homo Sapiens
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 967 - protein, 73 aa, Homo Sapiens
MSLLRNRLQALPALCLCVLVLACIGACQPEAQEGTLSPPPKLKMSRWSLVRGRMKELLETVVNRTRDGWQWFW

SEQ ID NO: 968 - protein, 127 aa, Homo Sapiens
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 969 - protein, 178 aa, Homo Sapiens
MSLLRNRLQALPALCLCVLVLACIGACQPEAQEGTLSPPPKLKMSRWSLVRGRMKELLETVVNRTRDGWQWFWSLDTMGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 970 - protein, 127 aa, Homo Sapiens; identical to SEQ ID NO: 968

SEQ ID NO: 971 - protein, 215 aa, Homo Sapiens
MFKQLSCISLPSSCDYSSRSLLQPPSPKMVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPK

SEQ ID NO: 972 - protein, 108 aa, Homo Sapiens
MVMLLLLLSALAGLFGAAEGQAFHLGKCPNPPVQENFDVNKTESHFVTQGGVQHHHLGSLQPPPPGFKQFSCLSLPSSWDYSISEDGTKLRRSQQPLRMDAASRPTTH

SEQ ID NO: 973 - protein, 149 aa, Homo Sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWIL

SEQ ID NO: 974 - protein, 189 aa, Homo Sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 975 - protein, 216 aa, Homo Sapiens
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSL

SEQ ID NO: 976 - protein, 219 aa, Homo Sapiens
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQ

SEQ ID NO: 977 - protein, 317 aa, Homo Sapiens [sequence omitted]

SEQ ID NO: 978 - protein, 269 aa, Homo Sapiens
MSSGASRKSWDPGNPWPPDWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRT

SEQ ID NO: 979 - protein, 326 aa, Homo Sapiens
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 980 - protein, 181 aa, Homo Sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMF

SEQ ID NO: 981 - protein, 345 aa, Homo Sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 982 - protein, 200 aa, Homo Sapiens
MRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSC

SEQ ID NO: 983 - protein, 104 aa, Homo Sapiens
  misc_feature (1)..(1): Xaa can be any naturally occurring amino acid
XQHAMFGNDTITCTTHGNWTKLPECREVKCPFPSRPDNGFVNYPAKPTLYYKDKATFGCHDGYSLDGPEEIECTKLGNWSAMPSCKEHSSLAFWKTDASDVKPC

SEQ ID NO: 984 - protein, 160 aa, Homo Sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRA

SEQ ID NO: 985 - protein, 398 aa, Homo Sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 986 - protein, 398 aa, Homo Sapiens; identical to SEQ ID NO: 985

SEQ ID NO: 987 - protein, 398 aa, Homo Sapiens; identical to SEQ ID NO: 985

SEQ ID NO: 988 - protein, 141 aa, Homo Sapiens
MEGAALLRVSVLCIWMSALFLGVGVRAEEAGARVQQNVPSGTDTGDPQSKPLGDWAAGTMDPGPAGSRGDSGEPCTLRPACRGQRQHGGASRISAEGPAPMPRRRTPSTAHLRVPKTSRRNLLCMRAVSLLRMPLSISRKK

SEQ ID NO: 989 - protein, 141 aa, Homo Sapiens; identical to SEQ ID NO: 988

SEQ ID NO: 990 - protein, 142 aa, Homo Sapiens
MEGAALLRVSVLCIWMSALFLGVGVRAEEAGARVQQNVPSGTDTGDPQSKPLGDWAAGTMDPGPAGSRGDSGEPCTLRPACRGQRQHGGASRISAEGPAPMPRRRTPSTAHLRVPKTSRRNLLCMVVVLNAVEFETLFLNFK

SEQ ID NO: 991 - protein, 380 aa, Homo Sapiens
MEGAALLRVSVLCIWVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 992 - protein, 123 aa, Homo Sapiens
MEGAALLRVSVLCIWVQQNVPSGTDTGDPQSKPLGDWAAGTMDPGPAGSRGDSGEPCTLRPACRGQRQHGGASRISAEGPAPMPRRRTPSTAHLRVPKTSRRNLLCMRAVSLLRMPLSISRKK

SEQ ID NO: 993 - protein, 414 aa, Homo Sapiens
MRFKSHTVELRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 994 - protein, 118 aa, Homo Sapiens
MRFKSHTVELRSTLSQPLFSCSRRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLT

SEQ ID NO: 995 - protein, 331 aa, Homo Sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 996 - protein, 402 aa, Homo Sapiens
MGLGQGWGWEASCFACLIRSCCQVVTFTFPFGFQGISQSLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 997 - protein, 97 aa, Homo Sapiens
MGLGQGWGWEASCFACLIRSCCQVVTFTFPFGFQGISQSLENVSGYYADARLEVGSTQLRTAGSCSHSFKRSFLGLRKKTNPSSQVSDWRAPWKVSQ

SEQ ID NO: 998 - protein, 82 aa, Homo Sapiens
MGLGQGWGWEASCFACLIRSCCQVVTFTFPFGFQGISQSLENVSGYYADARLEVGSTQLRTAGSCSHSFKRSFLGQKDPALV

SEQ ID NO: 999 - protein, 82 aa, Homo Sapiens; identical to SEQ ID NO: 998

SEQ ID NO: 1000 - protein, 202 aa, Homo Sapiens
MSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1001 - protein, 202 aa, Homo Sapiens; identical to SEQ ID NO: 1000

SEQ ID NO: 1002 - protein, 202 aa, Homo Sapiens; identical to SEQ ID NO: 1000

SEQ ID NO: 1003 - protein, 40 aa, Homo Sapiens
SQSLENVSGYYADARLEVGSTQLRTAGSCSHSFKRSFLGE

SEQ ID NO: 1004 - protein, 39 aa, Homo Sapiens
  misc_feature (1)..(1): Xaa can be any naturally occurring amino acid
XYADARLEVGSTQLRTAGSCSHSFKRSFLAWLPQPPRFL

SEQ ID NO: 1005 - protein, 86 aa, Homo Sapiens
  misc_feature (1)..(1): Xaa can be any naturally occurring amino acid
XYADARLEVGSTQLRTAGSCSHSFKRSFLAWWYVPVGTTTWEVEAEASLAARTYRQKQGGQRVSSTAPVNSPRQTLGHRVQDTDLE

SEQ ID NO: 1006 - protein, 33 aa, Homo Sapiens
  misc_feature (1)..(1): Xaa can be any naturally occurring amino acid
XYADARLEVGSTQLRTAGSCSHSFKRSFLEMSI

SEQ ID NO: 1007 - protein, 52 aa, Homo Sapiens
  misc_feature (1)..(1): Xaa can be any naturally occurring amino acid
XYADARLEVGSTQLRTAGSCSHSFKRSFLGLRKKTNPSSQVSDWRAPWKVSQ

SEQ ID NO: 1008 - protein, 52 aa, Homo Sapiens; identical to SEQ ID NO: 1007
  misc_feature (1)..(1): Xaa can be any naturally occurring amino acid

SEQ ID NO: 1009 - protein, 37 aa, Homo Sapiens
  misc_feature (1)..(1): Xaa can be any naturally occurring amino acid
XYADARLEVGSTQLRTAGSCSHSFKRSFLGQKDPALV

SEQ ID NO: 1010 - protein, 116 aa, Homo Sapiens
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 1011 - protein, 129 aa, Homo Sapiens
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQGKGLKSHKTGLGLTKSSGVTG

SEQ ID NO: 1012 - protein, 188 aa, Homo Sapiens
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 1013 - protein, 268 aa, Homo Sapiens
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 1014 - protein, 263 aa, Homo Sapiens [sequence omitted]

SEQ ID NO: 1015 - protein, 268 aa, Homo Sapiens [sequence omitted]

SEQ ID NO: 1016 - protein, 552 aa, Homo Sapiens
MAECNLVAILISSIDNPLDKNLDNGGNSCLDFRPLNSFSQPQVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 1017 - protein, 423 aa, Homo Sapiens
MIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 1018 - protein, 83 aa, Homo Sapiens
MVLLAAAVCTKAGKAIVSRQFVEMTRTRIEGLLAAFPKLMNTGKQHTFVETESIRMSSVLFPYQFIPSSLCQVVFLSGPVLPV

SEQ ID NO: 1019 - protein, 189 aa, Homo Sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQAQSVGITGMSHHAQLLLYFNP

SEQ ID NO: 1020 - protein, 511 aa, Homo Sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 1021 - protein, 256 aa, Homo Sapiens
MKPALCLVAMGALVMDSSPQCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 1022 - protein, 374 aa, Homo Sapiens
MTDGILGKAATMEIPIHGNGEARQLPEDDGLEQDLQQVMVSGPNLNETSIVSGGYGGSGDGLIPTGKSISCARREVWVGPQRCLVYLREAGVRELDPLGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 1023 - protein, 159 aa, Homo Sapiens
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKRNLATMQRHRNYYARMGKRC

SEQ ID NO: 1024 - protein, 341 aa, Homo Sapiens
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 1025 - protein, 341 aa, Homo Sapiens; identical to SEQ ID NO: 1024

SEQ ID NO: 1026 - protein, 202 aa, Homo Sapiens
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQPTGRTPSGWAQPYPQQHSPVEAA

SEQ ID NO: 1027 - protein, 303 aa, Homo Sapiens
MVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 1028 - protein, 535 aa, Homo Sapiens
MAWILDCLFASAFEPRPRRVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1029 - protein, 547 aa, Homo Sapiens
MGGCIPFLKAARALCPRIMPPLLLLSAFIFLVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1030 - protein, 411 aa, Homo Sapiens
MQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1031 - protein, 411 aa, Homo Sapiens; identical to SEQ ID NO: 1030

SEQ ID NO: 1032 - protein, 516 aa, Homo Sapiens
MSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1033 - protein, 218 aa, Homo Sapiens
MVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRV

SEQ ID NO: 1034 - protein, 78 aa, Homo Sapiens
GRQDGSESEAVAVALAGRLRELLRDLPPENRASLQYLLRHLRRPASSRLSSSTTAWSSRRSRRRPPGARTSHPTSELR

SEQ ID NO: 1035 - protein, 1019 aa, Homo Sapiens
MCICGTAHPVLDEGPVRCRAGPRDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1036 - protein, 1136 aa, Homo Sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1037 - protein, 1163 aa, Homo Sapiens
MFSRKKRELMKTPSISKKNRAGSPSPQPSGPHFISGETEAVSRPENPFNELPSDLPKELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1038 - protein, 60 aa, Homo Sapiens
MFSRKKRELMKTPSISKKNRAGSPSPQPSGTSLRPAARGPTSAWVRLCVSCIRSSPSTRC

SEQ ID NO: 1039 - protein, 771 aa, Homo Sapiens
MGVGRKGGAGETESHPRIGLELASWLPHPQQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1040 - protein, 1140 aa, Homo Sapiens
MLGRRLGARASYSPYRAGRQGPQQRGRDPGIQLTELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1041 - protein, 1152 aa, Homo Sapiens
MSRGQRVLKGLLGWVCTWTWAWRARLGARGCGLHVLCPRDLPLPPEELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 1042 - protein, 170 aa, Homo Sapiens
MVGSTPHFGDPCAGSPGPGGRGDPDGRGDPDGQGPELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQII

SEQ ID NO: 1043 - protein, 601 aa, Homo Sapiens
LELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 1044 - protein, 974 aa, Homo Sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 1045 - protein, 765 aa, Homo Sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 1046 - protein, 690 aa, Homo Sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSELELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSTSSVLPAAVQACPQYPASMFTP

SEQ ID NO: 1047 - protein, 771 aa, Homo Sapiens
MSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 1048 - protein, 771 aa, Homo Sapiens; identical to SEQ ID NO: 1047

SEQ ID NO: 1049 - protein, 1816 aa, Homo Sapiens
MLSVVHFLRSFFKTPEPGAHLPGEGEIEDNQLPTSPAEQVEQGWNQQTDRDDSETLSQQSESGSDTKTDPFESASDTESLSGYLPRGVFHPLRGTPVDIEAPWEYPDVSATGPPQEQHLTSVPGLHAKEELDLSPSLEDDSCKNGWRAFATVAGEQEAGHLWDCATSLERESLLAGVPRHTGCCLQRATDSSGPEPVQGVAVQDLRGLSSVSLQKSRSESYLGIPVVWPFLLWCCELGRSWPHIHNRARALVLPSRGPLDNTAPLGTRTKKESTLGPAGDTELLWSQPHSDVPCQPPLRTSCLLRTNRHHSAPETTGDKNRASPRLNCGHMRALVRAHSIAGFSPECPEDPVGQNVVKSGTHVKEGAKNERDPRIQNIPSPAPTQLSGPIPAFQSGAPHLQGPCKPGGFRLQRASQDTPSAGLLGENQLRQDSRSCLVASCLTSELVKLSAEEVPEPAECKSEQSPESRTQEPQGTQLAPRAADERETQKHLWGISVQAGNQTSNYTSKYVLSEESKSPTRAKFPRQPSSEGTQVWSGDLMGCLEVSDSSDAPETTQKSSAIDTSKAAEEAMVLDPNYREQALQGLSEFKAATVSHCGPGAEEGEQGPGGAGGRQLEPKAGGEASRGRGALIIVAVEQKGLQASRSNAGPVPETLPRDFPKERPESPLSTGETPCESPTRGKTPAGNECELPAAPIQGAGDGALQRVAQAAELGRVLVPQAASEETPSTEEPPGERLRGESRSSGSGERGPEEAPEGGAAAARGQRPRVPALEPPQPPRGLRKGAQEPGKRPTFSKVTSFRKGRPLATESPGGVPAPTTEGRRWGSSGPEGLPRENPPAAAGRDAPPLHHGDASAWPEFVPQAAGDRTAGPAGAGHTGTSGDLGSRGPSSESCNAKRLKTTEKKLRARLALAHKTFSNFIESIVLEKENTHERSPSSPKGEKEKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 1050 - protein, 690 aa, Homo Sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 1051 - protein, 670 aa, Homo Sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 1052 - protein, 630 aa, Homo Sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 1053 - protein, 192 aa, Homo Sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 1054 - protein, 517 aa, Homo Sapiens
MRGAVSRSWSLESLRSATAAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPK

SEQ ID NO: 1055 - protein, 619 aa, Homo Sapiens
MRPDGQQALDAVVRSFDCHSEAALRQRNDVIYCSLPRTAQGIVQREDQLEVLVSLREVWGRRRGRDGTCTGAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 1056 - protein, 372 aa, Homo Sapiens
PLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 1057 - protein, 287 aa, Homo Sapiens
  misc_feature (1)..(1): Xaa can be any naturally occurring amino acid
XACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 1058 - protein, 695 aa, Homo Sapiens
  misc_feature (1)..(1): Xaa can be any naturally occurring amino acid
XEGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 1059 - protein, 142 aa, Homo Sapiens
  misc_feature (1)..(1): Xaa can be any naturally occurring amino acid
XKKLRARLALAHKTFSNFIESIVLEKENTHERSPSSPKGEKEKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGDAKPR

SEQ ID NO: 1060 - protein, 173 aa, Homo Sapiens
MCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1061 - protein, 93 aa, Homo Sapiens
MDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1062 - protein, 93 aa, Homo Sapiens; identical to SEQ ID NO: 1061

SEQ ID NO: 1063 - protein, 93 aa, Homo Sapiens; identical to SEQ ID NO: 1061

SEQ ID NO: 1064 - protein, 111 aa, Homo Sapiens
MGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1065 - protein, 111 aa, Homo Sapiens; identical to SEQ ID NO: 1064

SEQ ID NO: 1066 - protein, 197 aa, Homo Sapiens
MRVAGGRALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1067 - protein, 197 aa, Homo Sapiens; identical to SEQ ID NO: 1066

SEQ ID NO: 1068 - protein, 48 aa, Homo Sapiens
VGTNLTDIVAQRKITIRELGGCMGPIWSSYYGNCRSLLACAADTSMEN

SEQ ID NO: 1069 - protein, 935 aa, Homo Sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 1070 - protein, 935 aa, Homo Sapiens; identical to SEQ ID NO: 1069

SEQ ID NO: 1071 - protein, 725 aa, Homo Sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGEFPYPPVSLPPCESPSSPMASMGPEPHLPTHLSSPARPPDNLSPEWGGEQGVPVPPWAHRQSSAVSSALALGPRYPNSRCSPAPRIWAGLCFFPGSAIGSALS

SEQ ID NO: 1072 - protein, 771 aa, Homo Sapiens
MKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 1073 - protein, 1030 aa, Homo Sapiens
MVTLGAGVRLFTGVYPVVLNQIRATSEASAITRTTMPAPELTSTSRAEDTRDTGVQLRKRKIPQARHSRKRQRTFSFRSLGSAARSGAESEARAKMAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 1074 - protein, 10 aa, Homo Sapiens
  misc_feature (1)..(1): Xaa can be any naturally occurring amino acid
XLGKCSAPVS

SEQ ID NO: 1075 - protein, 598 aa, Homo Sapiens
  misc_feature (1)..(1): Xaa can be any naturally occurring amino acid
XTEVRRLGGILPLVTILQCMKTDSIQNRTARALGNLAMEPESCGDIHCAGAVPLLVESLTACQDSQCLQSVALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 1076 - protein, 23 aa, Homo Sapiens
MADQRMDISSTISDFMSPGPTDL

SEQ ID NO: 1077 - protein, 59 aa, Homo Sapiens
MADQRMDISSTISDFMSPGPTDLLSSSLGTSGVDCNRKRKGSSTDYQESMDTDKDDPHG

SEQ ID NO: 1078 - protein, 76 aa, Homo Sapiens
MADQRMDISSTISDFMSPGPTDLLSSSLGTSGVDCNRKRKGSSTDYQESMDTDKDDPHGRLEYTEHQGRIKNAREA

SEQ ID NO: 1079 - protein, 101 aa, Homo Sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPT

SEQ ID NO: 1080 - protein, 135 aa, Homo Sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEA

SEQ ID NO: 1081 - protein, 626 aa, Homo Sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 1082 - protein, 625 aa, Homo Sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 1083 - protein, 60 aa, Homo Sapiens
MADQRMDISSTISDFMSPGPTDLLSSSLGTSGVDCNRKRKGSSTDYQLEYTEHQGRIKNA

SEQ ID NO: 1084 - protein, 46 aa, Homo Sapiens
MINIESMDTDKDDPHGRLEYTEHQGRIKNAREAHSQIEKRRRDKMN

SEQ ID NO: 1085 - protein, 72 aa, Homo Sapiens
MINIESMDTDKDDPHGRLEYTEHQGRIKNAREAHSQIEKRRRDKMNSFIDELASLVPTCNAMSRKLDKLTVL

SEQ ID NO: 1086 - protein, 141 aa, Homo Sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQ

SEQ ID NO: 1087 - protein, 583 aa, Homo Sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 1088 - protein, 582 aa, Homo Sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 1089 - protein, 624 aa, Homo Sapiens
MSKEAVSLWALTVSLQPPVPLCVCREMTGSGRRKQQCVTLPFISRELCFYLLLFPPPRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 1090 - protein, 171 aa, Homo Sapiens
RATAILAYLPQELLGTSCYEYFHQDDIGHLAECHRQVLQTREKITTNCYKFKIKDGSFITLRSRWFSFMNPWTKEVEYIVSTNTVVLSRVDTGHLGQVEWCTVLSRPDSRFLIAGMFTEPTSWKAGTQPSHSSQHPPTAWTACCPLEKVAQRGPTPLFQGFQGEPGLGQEK

SEQ ID NO: 1091 - protein, 423 aa, Homo Sapiens
MGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 1092 - protein, 509 aa, Homo Sapiens
MSMGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 1093 - protein, 509 aa, Homo Sapiens; identical to SEQ ID NO: 1092

SEQ ID NO: 1094 - protein, 509 aa, Homo Sapiens; identical to SEQ ID NO: 1092

SEQ ID NO: 1095 - protein, 509 aa, Homo Sapiens; identical to SEQ ID NO: 1092

SEQ ID NO: 1096 - protein, 69 aa, Homo Sapiens
  misc_feature (1)..(1): Xaa can be any naturally occurring amino acid
XPSYPDEVRGVFAVRTGKYKAHFFTQGSAHSDTTADPACHASSSLTAHEPPLLYDLSKDPDGVSLCRPG

SEQ ID NO: 1097 - protein, 45 aa, Homo Sapiens
MGPRGAASLPRGPGPRRLLLPVVLPLLLLLLLAPPGSGAGASRPP

SEQ ID NO: 1098 - protein, 533 aa, Homo Sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 1099 - protein, 413 aa, Homo Sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPYWPECSLLL

SEQ ID NO: 1100 - protein, 398 aa, Homo Sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTIRYLHPALFPPRTETPRAA

SEQ ID NO: 1101 - protein, 178 aa, Homo Sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLM

SEQ ID NO: 1102 - protein, 589 aa, Homo Sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1103 - protein, 614 aa, Homo Sapiens
MRPVINRCAPGSLDLMLPQAASEGIVFHSLQISLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1104 - protein, 544 aa, Homo Sapiens
MSGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1105 - protein, 361 aa, Homo Sapiens
MGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 1106 - protein, 29 aa, Homo Sapiens
MGWLFLKVLLAGVSFSGFLYPLVDFCISG

SEQ ID NO: 1107 - protein, 525 aa, Homo Sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 1108 - protein, 525 aa, Homo Sapiens; identical to SEQ ID NO: 1107

SEQ ID NO: 1109 - protein, 569 aa, Homo Sapiens
MHTLTGFSLVSLLSFGYLSWDWAKPSFVADGPGEAGEQPSAAPPQPPHIIFILTDDQGYHDVGYHGSDIETPTLDRLAAKGVKLENYYIQPICTPSRSQLLTGRYQIHTGLQHSIIRPQQPNCLPLDQVTLPQKLQEAGYSTHMVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 1110 - protein, 86 aa, Homo Sapiens
MVGKWHLGFYRKECLPTRRGFDTFLGSLTGNVDYYTYDNCDGPGVCGFDLHEGENVAWGLSGQYSTMLYAQRASHILASHSPQRPL

SEQ ID NO: 1111 - protein, 426 aa, Homo Sapiens
MVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 1112 - protein, 153 aa, Homo Sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSIRHSERGSTNQRSEKV

SEQ ID NO: 1113 - protein, 536 aa, Homo Sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 1114 - protein, 395 aa, Homo Sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDEKTEVEISKLLAEVHMASGILLEFLCLRT

SEQ ID NO: 1115 - protein, 46 aa, Homo Sapiens
MLLLWVSVVAALALAVLAPGAGEQRRRAAKAPNVVLVVSDSFIPDD

SEQ ID NO: 1116 - protein, 92 aa, Homo Sapiens
RAAKAPNVVLVVSDSFDGRLTFHPGSQVVKLPFINFMKTRGTSFLNAYTNSPICCPSRAVIVWKRGQEMLLSYSDKKAGPWLILSVTGLKSE

SEQ ID NO: 1117 - protein, 117 aa, Homo Sapiens
KTCSHYECAFLGGLKTENCIENLEYFQPIYVYNPGEKNQKLEDHSEKNWKLEDHGEKNQKLEDHGVKILEPTQIPGMKIPEPFPLPGIKMIQLNEKPEDKSQGNINNPTPGPVPVPG

SEQ ID NO: 1118 - protein, 107 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQE

SEQ ID NO: 1119 - protein, 129 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDY

SEQ ID NO: 1120 - protein, 175 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGL

SEQ ID NO: 1121 - protein, 202 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLS

SEQ ID NO: 1122 - protein, 389 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPGMKIPEPFPLPEDKSQGNINNPTPGPVPVPGPKSHPSASSGKLLLPQFGMVIILISVSAINLFVAL

SEQ ID NO: 1123 - protein, 378 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPEDKSQGNINNPTPGPVPVPGPKSHPSASSGKLLLPQFGMVIILISVSAINLFVAL

SEQ ID NO: 1124 - protein, 367 aa, Homo Sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPAPGPVPVPGPKSHPSASSGKLLLPQFGMVIILISVSAINLFVAL

SEQ ID NO: 1125 - protein, 314 aa, Homo Sapiens
MGPLINRCKKILLPTTVPPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKASSKKCIPDPIAIASLSFLTSVIIFSKSRV

SEQ ID NO: 1126 - protein, 41 aa, Homo Sapiens
PPATMRIWLLGGLLPFLLLLSGLQRPTEGSELPARNASLIL

SEQ ID NO: 1127 - protein, 65 aa, Homo Sapiens
PPATMRIWLLGGLLPFLLLLSGLQRPTEGSEVAIKIDFDFAPGSFDDQYQGCSKQLPARNASLIL

SEQ ID NO: 1128 - protein, 273 aa, Homo Sapiens
PPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKGILYLN

SEQ ID NO: 1129 - protein, 152 aa, Homo Sapiens
AVPILPLGLAPDTFDDTYVGCAEEMEEKAAPLLKEEMAHHALLRESWEAAQETWEDKRRGLTLPPGFKAQNGIAIMVYTNSSNTLYWELNQAAFSVFPKEREVLIPPHEVFLVTRFSQDGAQSLVTLWSYNQTCSHFNCAYLGGEKRRGCVS

SEQ ID NO: 1130 - protein, 239 aa, Homo Sapiens
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGEKRRGCVSAPGVQLGSQSEGASSLPPWKTLLLAPGEFQLSGVGP

SEQ ID NO: 1131 - protein, 291 aa, Homo Sapiens
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 1132 - protein, 291 aa, Homo Sapiens; identical to SEQ ID NO: 1131

SEQ ID NO: 1133 - protein, 264 aa, Homo Sapiens
  misc_feature (1)..(1): Xaa can be any naturally occurring amino acid
XEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGVQLGSQSEGASSLPPWKTLLLAPGEFQLSGVGP

SEQ ID NO: 1134 - protein, 89 aa, Homo Sapiens
MELGLGGLSTLSHCPWPRQQAPLGLSAQPALWPTLAALALLSSVAEASLGSAPRSPAPREGPPPVLASPAGHLPGGRTARWCSGRARRP

SEQ ID NO: 1135 - protein, 89 aa, Homo Sapiens; identical to SEQ ID NO: 1134

SEQ ID NO: 1136 - protein, 228 aa, Homo Sapiens
MELGLGGLSTLSHCPWPRQQAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 1137 - protein, 228 aa, Homo Sapiens; identical to SEQ ID NO: 1136

SEQ ID NO: 1138 - protein, 76 aa, Homo Sapiens
MELGLGGLSTLSHCPWPRQQAPLGLSAQPALWPTLAALALLSSVAEASLGSAPRSPAPREGPPPVLASPAGHLPGR

SEQ ID NO: 1139 - protein, 76 aa, Homo Sapiens; identical to SEQ ID NO: 1138

SEQ ID NO: 1140 - protein, 66 aa, Homo Sapiens
MELGLGGLSTLSHCPWPRQQPALWPTLAALALLSSVAEASLGSAPRSPAPREGPPPVLASPAGHLP

SEQ ID NO: 1141 - protein, 66 aa, Homo Sapiens; identical to SEQ ID NO: 1140

SEQ ID NO: 1142 - protein, 220 aa, Homo Sapiens
MELGLGGLSTLSHCPWPRQQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 1143 - protein, 220 aa, Homo Sapiens; identical to SEQ ID NO: 1142

SEQ ID NO: 1144 - protein, 237 aa, Homo Sapiens
MPGLISARGQPLLEVLPPQAHLGALFLPEAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 1145 - protein, 31 aa, Homo Sapiens
GRAVDRGLQKINLSSFRTNVQRCSSMVHHKS

SEQ ID NO: 1146 - protein, 125 aa, Homo Sapiens
MLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLD

SEQ ID NO: 1147 - protein, 151 aa, Homo Sapiens
MLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKP

SEQ ID NO: 1148 - protein, 330 aa, Homo Sapiens
MLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1149 - protein, 330 aa, Homo Sapiens; identical to SEQ ID NO: 1148

SEQ ID NO: 1150 - protein, 110 aa, Homo Sapiens
MLDKAPVLKVIVNSLKNMINTFVPSGKIMQVVDEKLPGLLGNFPGPFEEEMKGIAAVTDIPLGKVHLEALKKKVIKFFYKFPLRCDIHTAQVLYVLDIQHRCTGLRYTAQ

SEQ ID NO: 1151 - protein, 110 aa, Homo Sapiens; identical to SEQ ID NO: 1150

SEQ ID NO: 1152 - protein, 187 aa, Homo Sapiens
MNCCIGLGEKARGSHRASYPSLSALFTEASILGFGSFAVKAQVAWKALSLSLRHPFRGTEKPRPLLPVPPPPSVPPTAWNGAVPGRGSRGGGGVACPRPSRLFFASAGVRGVALAARAMPGRSCVALVLLAAAVSCAVAQHAPPWTEDCRKSTYPPSGPTYRGAVPWYTINLDLPPYKRWHELMLDK

SEQ ID NO: 1153 - protein, 72 aa, Homo Sapiens
MNCCIGLGEKARGSHRASYPSLSALFTEASILGFGSFAVKAQVGNQQLGGPEWIRFSLTPRPLNCSLSLTPR

SEQ ID NO: 1154 - protein, 97 aa, Homo Sapiens
MNCCIGLGEKARGSHRASYPSLSALFTEASILGFGSFAVKAQVGNQQLGGPEWIRFSLTPRPLNCSLSLTPRGQRTAENQPILLQDQRTEVQFHGTP

SEQ ID NO: 1155 - protein, 74 aa, Homo Sapiens
MNCCIGLGEKARGSHRASYPSLSALFTEASILGFGSFAVKAQVGNQQLGGPEWIRFSLTPRPLNCSLSLTPRWG

SEQ ID NO: 1156 - protein, 74 aa, Homo Sapiens; identical to SEQ ID NO: 1155

SEQ ID NO: 1157 - protein, 74 aa, Homo Sapiens; identical to SEQ ID NO: 1155

SEQ ID NO: 1158 - protein, 74 aa, Homo Sapiens; identical to SEQ ID NO: 1155

SEQ ID NO: 1159 - protein, 74 aa, Homo Sapiens; identical to SEQ ID NO: 1155

SEQ ID NO: 1160 - protein, 71 aa, Homo Sapiens
MNCCIGLGEKARGSHRASYPSLSALFTEASILGFGSFAVKAQVVDRGLQKINLSSFRTNVQRCSSMVHHKS

SEQ ID NO: 1161 - protein, 58 aa, Homo Sapiens
MNCCIGLGEKARGSHRASYPSLSALFTEASILGFGSFAVKAQWTEDCRKSTYPPSGPT

SEQ ID NO: 1162 - protein, 59 aa, Homo Sapiens
MNCCIGLGEKARGSHRASYPSLSALFTEASILGFGSFAVKAQWTEDCRKSTYPPSGPTL

SEQ ID NO: 1163 - protein, 389 aa, Homo Sapiens
MNCCIGLGEKARGSHRASYPSLSALFTEASILGFGSFAVKAQWTEDCRKSTYPPSGPTVFPAVIRYRGAVPWYTINLDLPPYKRWHELMLDKAPVPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1164 - protein, 411 aa, Homo Sapiens
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1165 - protein, 341 aa, Homo Sapiens
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYEISHLKPCMMSCQQNLSSTS

SEQ ID NO: 1166 - protein, 386 aa, Homo Sapiens
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1167 - protein, 191 aa, Homo Sapiens
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGKVHLEALKKKVIKFFYKFPLRCDIHTAQVLYVLDIQHRCTGLRYTAQ

SEQ ID NO: 1168 - protein, 140 aa, Homo Sapiens
MNCCIGLGEKARGSHRASYPSLSALFTEASILGFGSFAVKAQWTEDCRKSTYPPSGPTYRGAVPWYTINLDLPPYKRWHELMLDKAPVVIVNSLKNMINTFVPSGKIMQVVDEKLPGLLGNFPGPFEEEMKGIAAVTDIP

SEQ ID NO: 1169 - protein, 49 aa, Homo Sapiens
MPGRSCVALVLLAAAVSCAVAQHAPPRTAENQPILLQDQRTEVQFHGTP

SEQ ID NO: 1170 - protein, 81 aa, Homo Sapiens
MPGRSCVALVLLAAAVSCAVAQHAPPVSELEPRRREGRAGAGADGGAGVAARAVDRGLQKINLSSFRTNVQRCSSMVHHKS

SEQ ID NO: 1171 - protein, 75 aa, Homo Sapiens
MPGRSCVALVLLAAAVSCAVAQHAPPVSELEPRRREGRAGAGADGGAVDRGLQKINLSSFRTNVQRCSSMVHHKS

SEQ ID NO: 1172 - protein, 75 aa, Homo Sapiens; identical to SEQ ID NO: 1171

SEQ ID NO: 1173 - protein, 67 aa, Homo Sapiens
MPGRSCVALVLLAAAVSCAVAQHAPPVSELEPRRREGRAVDRGLQKINLSSFRTNVQRCSSMVHHKS

SEQ ID NO: 1174 - protein, 42 aa, Homo Sapiens
MPGRSCVALVLLAAAVSCAVAQHAPPWTEDCRKSTYPPSGPT

SEQ ID NO: 1175 - protein, 42 aa, Homo Sapiens; identical to SEQ ID NO: 1174

SEQ ID NO: 1176 - protein, 42 aa, Homo Sapiens; identical to SEQ ID NO: 1174

SEQ ID NO: 1177 - protein, 56 aa, Homo Sapiens
MPGRSCVALVLLAAAVSCAVAQHAPPWTEDCRKSTYPPSGPTLAYLATFLALLKRK

SEQ ID NO: 1178 - protein, 184 aa, Homo Sapiens
MPGRSCVALVLLAAAVSCAVAQHAPPWTEDCRKSTYPPSGPTVFPAVIRYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWV

SEQ ID NO: 1179 - protein, 62 aa, Homo Sapiens
MPGRSCVALVLLAAAVSCAVAQHAPPWTEDCRKSTYPPSGPTYRGAVPWYTINLDLPPYKRC

SEQ ID NO: 1180 - protein, 185 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGEIISFNIFYELFTICTSIVAEDKKGHLIHGRNMDFGVFLGWNINNDTWVITEQLKPLTVNLDFQRNN

SEQ ID NO: 1181 - protein, 375 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1182 - protein, 374 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1183 - protein, 395 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1184 - protein, 395 aa, Homo Sapiens; identical to SEQ ID NO: 1183

SEQ ID NO: 1185 - protein, 395 aa, Homo Sapiens; identical to SEQ ID NO: 1183

SEQ ID NO: 1186 - protein, 173 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGNCALREGGQHEALHKEKSSK

SEQ ID NO: 1187 - protein, 370 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1188 - protein, 288 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1189 - protein, 175 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGKVHLEALKKKVIKFFYKFPLRCDIHTAQVLYVLDIQHRCTGLRYTAQ

SEQ ID NO: 1190 - protein, 376 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1191 - protein, 246 aa, Homo Sapiens
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVY

SEQ ID NO: 1192 - protein, 366 aa, Homo Sapiens
MPGRSCVALVLLAAAVSCAVAQHAPPWTEDCRKSTYPPSGPTYRGAVPWYTINLDLPPYKRWHELMLDKAPVPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1193 - protein, 393 aa, Homo Sapiens
MPGRSCVALVLLAAAVSCAVAQHAPPWTEDCRKSTYPPSGPTYRGAVPWYTINLDLPPYKRWHELMLDKAPVVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1194 - protein, 368 aa, Homo Sapiens
  misc_feature (1)..(1): Xaa can be any naturally occurring amino acid
XLAAAVSCAVAQHAPPVSELEPRRREGRAVDRGLQKINLSSFRTNLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1195 - protein, 200 aa, Homo Sapiens
  misc_feature (1)..(1): Xaa can be any naturally occurring amino acid
XNNKTVFKASSFAGYVGMLTGFKPGLFSLTLNERFSINGGYLEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 1196 - protein, 51 aa, Homo Sapiens
AQRYEAASTIYGPHTLSAYIQLFRNLAKAIATELHLWKSSLWMQLFMKLQL

SEQ ID NO: 1197 - protein, 144 aa, Homo Sapiens
AQRYEAASTIYGPHTLSAYIQLFRNLAKAIATGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 1198 - protein, 780 aa, Homo Sapiens
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 1199 - protein, 745 aa, Homo Sapiens
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 1200 - protein, 622 aa, Homo Sapiens
MDSEKSSEWRSDVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 1201 - protein, 726 aa, Homo Sapiens
MSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 1202 - protein, 236 aa, Homo Sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1203 - protein, 132 aa, Homo Sapiens
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 1204 - protein, 132 aa, Homo Sapiens; identical to SEQ ID NO: 1203

SEQ ID NO: 1205 - protein, 243 aa, Homo Sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKDNLPSF

SEQ ID NO: 1206 - protein, 380 aa, Homo Sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 1207 - protein, 431 aa, Homo Sapiens
MEGVGGLWPWVLGLLSLPGVILGAPLASSCAGACGTSFPDGLTPEGTQASGDKDIPAINQGLILEETPESSFLIEGDIIRPSPFRLLSATSNKWPMGGSGVVEVPFLLSSKYDEPSRQVILEALAEFERSTCIRFVTYQDQRDFISIIPMYGCFSSVGRSGGMQVVSLAPTCLQKGRGIVLHELMHVLGFWHEHTRADRDRYIRVNWNEILPGFEINFIKSQSSNMLTPYDYSSVMHYGRLAFSRRGLPTITPLWAPSVHIGQRWNLSASDITRVLKLYGCSPSGPRPRGRGSHAHSTGRSPAPASLSLQRLLEALSAESRSPDPSGSSAGGQPVPAGPGESPHGWESPALKKLSAEASARQPQTLASSPRSRPGAGAPGVAQEQSWLAGVSTKPTVPSSEAGIQPVPVQGSPALPGGCVPRNHFKGMSED

SEQ ID NO: 1208 - protein, 1844 aa, Homo Sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPKSSGPKRALPPKTLANYFKVSPKPKNNEEIGMLLENNKGIKNSFEQKQITQTKSTNATNSNVKDVGAEEPSRKNATSLILFEEVDVIFDEDAGFLNAIKTFMATTKRPVILTTSDPTFSLMFDGCFEEIKFSTPSLLNVASYLQMICLTENFRTDVKDFVTLLTANTCDIRKSILYLQFWIRSGGGVLEERPLTLYRGNSRNVQLVCSEHGLDNKIYPKNTKKKRVDLPKCDSGCAETLFGLKNIFSPSEDLFSFLKHKITMKEEWHKFIQLLTEFQMRNVDFLYSNLEFILPLPVDTIPETKNFCGPSVTVDASAATKSMNCLARKHSEREQPLKKSQKKKQKKTLVILDDSDLFDTDLDFPDQSISLSSVSSSSNAEESKTGDEESKARDKGNNPETKKSIPCPPKTTAGKKCSALVSHCLNSLSEFMDNMSFLDALLTDVREQNKYGRNDFSWTNGKVTSGLCDEFSLESNDGWTSQSSGELKAAAEALSFTKCSSAISKALETLNSCKKLGRDPTNDLTFYVSQKRNNVYFSQSAANLDNAWKRISVIKSVFSSRSLLYVGNRQASIIEYLPTLRNICKTEKLKEQGKSKRRFLHYFEGIHLDIPKETVNTLAADFP

SEQ ID NO: 1209 - protein, 1224 aa, Homo Sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPK

SEQ ID NO: 1210 - protein, 310 aa, Homo Sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 1211 - protein, 300 aa, Homo Sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 1212 - protein, 333 aa, Homo Sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 1213 - protein, 421 aa, Homo Sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 1214 - protein, 323 aa, Homo Sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 1215 - protein, 409 aa, Homo Sapiens
MWLTWPFCFLTITLREEGVCHLESVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 1216 - protein, 331 aa, Homo Sapiens
MAVAMVKLCERAGLPLLAAPLLRSLLPRAPQPGPAQPRSVQGQRCPARHPPGNLVCERGAGVNGVTAGAGGRLRGLHRGGRALGCSAHRPLHSARVRPPAHLAAPPGSSARGCRLTELGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 1217 - protein, 1938 aa, Homo Sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 1218 - protein, 1742 aa, Homo Sapiens
  misc_feature (1)..(1): Xaa can be any naturally occurring amino acid
XYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKVQLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 1219 - protein, 153 aa, Homo Sapiens
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPED

SEQ ID NO: 1220 - protein, 197 aa, Homo Sapiens
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 1221 - protein, 159 aa, Homo Sapiens
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEEIPPGED

SEQ ID NO: 1222 - protein, 44 aa, Homo Sapiens
MTDDKDVLRDVWFGRIPTCFTLYQDEITEREAEPYYALSNWFAI

SEQ ID NO: 1223 - protein, 162 aa, Homo Sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDND

SEQ ID NO: 1224 - protein, 275 aa, Homo Sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 1225 - protein, 275 aa, Homo Sapiens; identical to SEQ ID NO: 1224

SEQ ID NO: 1226 - protein, 233 aa, Homo Sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQVTAVWVGIQRFQASEEESEDEEFLATLTGGERSGKARKQWTQ

SEQ ID NO: 1227 - protein, 91 aa, Homo Sapiens
MTDDKDVLRDVWFGRIPTCFTLYQDEITEREAEPYYTDLTSFGPSIGNSWNILQKKMDFVISPLEYIRQRLKDLSFRSCFVLWLQMDSCTH

SEQ ID NO: 1228 - protein, 823 aa, Homo Sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 1229 - protein, 55 aa, Homo Sapiens
MKMHAEKKHKCSKCSNSYGTEWDLKRHAEDCGKTFRCTCGCPYASRTALQSHIYR

SEQ ID NO: 1230 - protein, 667 aa, Homo Sapiens
MKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 1231 - protein, 667 aa, Homo Sapiens; identical to SEQ ID NO: 1230

SEQ ID NO: 1232 - protein, 1204 aa, Homo Sapiens
MAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 1233 - protein, 1086 aa, Homo Sapiens
MEKWEELNSHQPGEEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 1234 - protein, 185 aa, Homo Sapiens
  misc_feature (1)..(1): Xaa can be any naturally occurring amino acid
XASPWVPAAAFLSVTIATWATHLPGLDSQGHPLHFGAGLIMTPLLTCCACLEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYS

SEQ ID NO: 1235 - protein, 256 aa, Homo Sapiens
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 1236 - protein, 195 aa, Homo Sapiens
MLSRVVLSAAATAGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 1237 - protein, 128 aa, Homo Sapiens
AQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLEHTQVRRCPIHSGPHSGPPFQGGP

SEQ ID NO: 1238 - protein, 281 aa, Homo Sapiens
MAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 1239 - protein, 273 aa, Homo Sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVARDVAVVAGGLGRQLLQKQPVSPVIHPPVSYNDTAPRILFWAQNFSVAYKDQWEDLTPLTFGVQELNLTGSFWNDSFARFILANRLYPVSARHWFTMERLEVHSNGSVAYFNAS

SEQ ID NO: 1240 - protein, 230 aa, Homo Sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTDEVIGQVLSTLKSEDVPYTAALTAVRPSRVARD

SEQ ID NO: 1241 - protein, 470 aa, Homo Sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 1242 - protein, 134 aa, Homo Sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKVRPPQPTLPRSSGGSQAPSPHDTDAHSPREASVTLSQL

SEQ ID NO: 1243 - protein, 134 aa, Homo Sapiens; identical to SEQ ID NO: 1242

SEQ ID NO: 1244 - protein, 133 aa, Homo Sapiens
  misc_feature (1)..(1): Xaa can be any naturally occurring amino acid
XAAMATARVRMGPRCAQALWRMPWLPVFLSLAAAAAAAAAEQQVPLVLWSSDRDLWAPAADTHEGHITSDLQLSTYLDPALELGPRNVLLFLQDKVRPPQPTLPRSSGGSQAPSPHDTDAHSPREASVTLSQL

SEQ ID NO: 1245 - protein, 186 aa, Homo Sapiens
FHRPRATVMVMVKGVNKLALPPGSVISYPLENLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1246 - protein, 186 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNENALFFWAL

SEQ ID NO: 1247 - protein, 209 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLGETTYLPRTQAWA

SEQ ID NO: 1248 - protein, 345 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1249 - protein, 331 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1250 - protein, 349 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQANPASPYNLAYKYNFEYSVVFNMVLWIMIALALAVIITSYNIWNMDPGYDSIIYRMTNQKIRMD

SEQ ID NO: 1251 - protein, 350 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1252 - protein, 258 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKMTCTVFMVGMQW

SEQ ID NO: 1253 - protein, 262 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKSLWWECSGRVSHCQVI

SEQ ID NO: 1254 - protein, 143 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEESVYGREGKLSV

SEQ ID NO: 1255 - protein, 318 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1256 - protein, 317 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQANPASPYNLAYKYNFEYSVVFNMVLWIMIALALAVIITSYNIWNMDPGYDSIIYRMTNQKIRMD

SEQ ID NO: 1257 - protein, 272 aa, Homo Sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1258 - protein, 128 aa, Homo Sapiens
MGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNN

SEQ ID NO: 1259 - protein, 301 aa, Homo Sapiens
MGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1260 - protein, 274 aa, Homo Sapiens
MVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1261 - protein, 273 aa, Homo Sapiens
MVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQANPASPYNLAYKYNFEYSVVFNMVLWIMIALALAVIITSYNIWNMDPGYDSIIYRMTNQKIRMD

SEQ ID NO: 1262 - protein, 59 aa, Homo Sapiens
MVMVKGVNKLALPPGSVISYPLENFLLVLTVLQIPFTPYFLRKLLLFCSWLPVRKECIW

SEQ ID NO: 1263 - protein, 101 aa, Homo Sapiens
MVMVKGVNKLALPPGSVISYPLENRVYMVGKANSVFEDLSVTLRQLRNRLFQENSVLSSLPLNSLSRNNEVDLLFLSELQVLHDISSLGETTYLPRTQAWA

SEQ ID NO: 1264 - protein, 242 aa, Homo Sapiens
MVMVKGVNKLALPPGSVISYPLENRVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1265 - protein, 196 aa, Homo Sapiens
MVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1266 - protein, 294 aa, Homo Sapiens
  misc_feature (1)..(1): Xaa can be any naturally occurring amino acid
XEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKKNPASPYNLAYKYNFEYSVVFNMVLWIMIALALAVIITSYNIWNMDPGYDSIIYRMTNQKIRMD

SEQ ID NO: 1267 - protein, 76 aa, Homo Sapiens
  misc_feature (1)..(1): Xaa can be any naturally occurring amino acid
XSLYGGNAVVELVTVKSFDTSLIRKTRTILEAKQAEKEHVYQKKKKERNKEVFMGVKSFNVCLSSELPAEEPSKSL

SEQ ID NO: 1268 - protein, 113 aa, Homo Sapiens
FLCALPRREGYEFFVGQWTGTELHFTALINIQTRGEAAASQLILYHYPELKEEKGIVLMTAEMDSTFLNVAEAQCIANQVQLFYATDRKETYGWAQLLAIHSTLIHLHQRVRK

SEQ ID NO: 1269 - protein, 174 aa, Homo Sapiens
LIRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 1270 - protein, 328 aa, Homo Sapiens
MAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 1271 - protein, 351 aa, Homo Sapiens
MERARGPRAEADAPEEEEEAGAAMAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 1272 - protein, 351 aa, Homo Sapiens; identical to SEQ ID NO: 1271

SEQ ID NO: 1273 - protein, 283 aa, Homo Sapiens
MERARGPRAEADAPEEEEEAGAAMAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 1274 - protein, 45 aa, Homo Sapiens
MSDPAAFESRLEKRSEFRKQPVGHSRQGDFIKCVEQKDGAQNKLV

SEQ ID NO: 1275 - protein, 240 aa, Homo Sapiens
MSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 1276 - protein, 177 aa, Homo Sapiens
MVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 1277 - protein, 183 aa, Homo Sapiens
  misc_feature (1)..(1): Xaa can be any naturally occurring amino acid
XGKQSVNRGFTKDKTLSSIFNIEMVKEKTAEEIKQAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 1278 - protein, 86 aa, Homo Sapiens
  misc_feature (1)..(1): Xaa can be any naturally occurring amino acid
XVRPGSGRPEGGADSSGVGAEAELQANPFYDRYRDKIQLLRRSDPAAFESRLEKRSEFRKQPVGHSRQGDFIKCVEQKDGAQNKLV

SEQ ID NO: 1279 - protein, 310 aa, Homo Sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 1280 - protein, 339 aa, Homo Sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 1281 - protein, 164 aa, Homo Sapiens
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 1282 - protein, 151 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKP

SEQ ID NO: 1283 - protein, 192 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLT

SEQ ID NO: 1284 - protein, 192 aa, Homo Sapiens; identical to SEQ ID NO: 1283

SEQ ID NO: 1285 - protein, 843 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 1286 - protein, 778 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 1287 - protein, 271 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGY

SEQ ID NO: 1288 - protein, 778 aa, Homo Sapiens; identical to SEQ ID NO: 1286

SEQ ID NO: 1289 - protein, 160 aa, Homo Sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKDFCHDILFYLYCKLCIIKSSFKENYLVQ

SEQ ID NO: 1290 - protein, 227 aa, Homo Sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQGTHCFLLPSTEPRIKDDLRLGAQATS

SEQ ID NO: 1291 - protein, 298 aa, Homo Sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 1292 - protein, 85 aa, Homo Sapiens
  misc_feature (1)..(1): Xaa can be any naturally occurring amino acid
XTYIYTGLSKHVEDVPAFQALGSLNDLQFFRYNSKDRKSQPMGLWRQQKYPGPARSSLCGGHQPPGPRRKEETEVPGLRLLPREN

SEQ ID NO: 1293 - protein, 150 aa, Homo Sapiens
MTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 1294 - protein, 251 aa, Homo Sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 1295 - protein, 71 aa, Homo Sapiens
GFHPSDIEVDLLKNGERIEKVEHSDLSFSKDWSFYLLYYTEFTPTEKDEYACRVNHVTLSQPKIVKWDRDM

SEQ ID NO: 1296 - protein, 51 aa, Homo Sapiens
MSRSVALAVLALLSLSGLEAIQHSGLLTSSSREWKVKFPELLCVWVSSIRH

SEQ ID NO: 1297 - protein, 101 aa, Homo Sapiens
MSRSVALAVLALLSLSGLEAIQRTPKIQVYSRHPADIEVDLLKNGERIEKVEHSDLSFSKDWSFYLLYYTEFTPTEKDEYACRVNHVTLSQPKIVKWDRDM

SEQ ID NO: 1298 - protein, 119 aa, Homo Sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 1299 - protein, 119 aa, Homo Sapiens; identical to SEQ ID NO: 1298

SEQ ID NO: 1300 - protein, 119 aa, Homo Sapiens; identical to SEQ ID NO: 1298

SEQ ID NO: 1301 - protein, 57 aa, Homo Sapiens
MSRSVALAVLALLSLSGLERELKKWSIQTCLSARTGLSISCTTLNSPPLKKMSMPAV

SEQ ID NO: 1302 - protein, 41 aa, Homo Sapiens
MASALWTVLPSRMSLRSLKWSLLLLSLLSFFVMWYLSLPHY

SEQ ID NO: 1303 - protein, 46 aa, Homo Sapiens
MASALWTVLPSRMSLRSLKWSLLLLSLLSFFVMWYLSLPHYNVIER

SEQ ID NO: 1304 - protein, 54 aa, Homo Sapiens
MASALWTVLPSRMSLRSLKWSLLLLSLLSFFVMWYLSLPHYNVIERVNWMYFYE

SEQ ID NO: 1305 - protein, 91 aa, Homo Sapiens
MASALWTVLPSRMSLRSLKWSLLLLSLLSFFVMWYLSLPHYNVIERVNWMYFYEIHLDVCQLRRVIAAHGFSSKEIITFWQVMLRNTTCHY

SEQ ID NO: 1306 - protein, 58 aa, Homo Sapiens
MASALWTVLPSRMSLRSLKWSLLLLSLLSFFVMWYLSLPHYNVIERVNWMYFYEYEPI

SEQ ID NO: 1307 - protein, 65 aa, Homo Sapiens
MASALWTVLPSRMSLRSLKWSLLLLSLLSFFVMWYLSLPHYNVIERVNWMYFYEYEPIYRQDFHF

SEQ ID NO: 1308 - protein, 111 aa, Homo Sapiens
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYE

SEQ ID NO: 1309 - protein, 331 aa, Homo Sapiens
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 1310 - protein, 331 aa, Homo Sapiens; identical to SEQ ID NO: 1309

SEQ ID NO: 1311 - protein, 331 aa, Homo Sapiens; identical to SEQ ID NO: 1309

SEQ ID NO: 1312 - protein, 331 aa, Homo Sapiens; identical to SEQ ID NO: 1309

SEQ ID NO: 1313 - protein, 331 aa, Homo Sapiens; identical to SEQ ID NO: 1309

SEQ ID NO: 1314 - protein, 150 aa, Homo Sapiens
MSFFLFSEFTTDLSVLIKHGIQKTTKNLSFNFIWNSTVFLAPWTRLTCWLFPLAALSRGALRLLTPSVKSCCSVAQAGVQWQDLSSLQSPSLRFKQFSCLSLPSRWDYRTFGSRASELLWMASALWTVLPSRMSLRSLKWSLLLLSLLSF

SEQ ID NO: 1315 - protein, 92 aa, Homo Sapiens
MRNWLVLLCPCVLGAALHLWLRLRSPPPACASGAGPADQLALFPQWKSTHYDVVVGVLSARNNHELRNVIRSTWMRHLLQHPTLSQRFESGN

SEQ ID NO: 1316 - protein, 500 aa, Homo Sapiens
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 1317 - protein, 326 aa, Homo Sapiens
MRNWLVLLCPCVLGAALHLWLRLRSPPPACASGAGPAGGVSLLLPRLECNGAVSAHPNLHLPGSRDSPASASQVAGITDQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQGKFAS

SEQ ID NO: 1318 - protein, 326 aa, Homo Sapiens
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 1319 - protein, 378 aa, Homo Sapiens
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 1320 - protein, 310 aa, Homo Sapiens
MAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 1321 - protein, 310 aa, Homo Sapiens; identical to SEQ ID NO: 1320

SEQ ID NO: 1322 - protein, 310 aa, Homo Sapiens; identical to SEQ ID NO: 1320

SEQ ID NO: 1323 - protein, 310 aa, Homo Sapiens; identical to SEQ ID NO: 1320

SEQ ID NO: 1324 - protein, 314 aa, Homo Sapiens
MCLEMAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 1325 - protein, 329 aa, Homo Sapiens
MKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 1326 - protein, 223 aa, Homo Sapiens
MKLKLKNVFLAYFLVSIAGLLYALVQLAKGMDRTLPLMQRFRDSATALSSGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYS

SEQ ID NO: 1327 - protein, 335 aa, Homo Sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 1328 - protein, 319 aa, Homo Sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRSLAVSPRLECSSAILA

SEQ ID NO: 1329 - protein, 315 aa, Homo Sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRTESRCVTQAGVQ

SEQ ID NO: 1330 - protein, 38 aa, Homo Sapiens
MKLKLKNVFLAYFLVSIAGLLYALVQLVSASSTKQKAR

SEQ ID NO: 1331 - protein, 498 aa, Homo Sapiens
MRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCRKPVKKKDIFVAVKTCKKFHGDRIPIVKQTWESQASLIEYYSDYTENSIPTVDLGIPNTDRGHCGKTFAILERFLNRSQDKTAWLVIVDDDTLISISRLQHLLSCYDSGEPVFLGERYGYGLGTGGYSYITGGGGMVFSREAVRRLLASKCRCYSNDAPDDMVLGMCFSGLGIPVTHSPLFHQARPVDYPKDYLSHQVPISFHKHWNIDPVKVYFTWLAPSDEDKARQETQKGFREEL

SEQ ID NO: 1332 - protein, 127 aa, Homo Sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLR

SEQ ID NO: 1333 - protein, 250 aa, Homo Sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWS

SEQ ID NO: 1334 - protein, 372 aa, Homo Sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQRLSSFDPCFYRDLLLVHRFLPYEMLLMWDALNQPNLTCGNQTQIY

SEQ ID NO: 1335 - protein, 372 aa, Homo Sapiens; identical to SEQ ID NO: 1334

SEQ ID NO: 1336 - protein, 353 aa, Homo Sapiens
MLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 1337 - protein, 353 aa, Homo Sapiens; identical to SEQ ID NO: 1336

SEQ ID NO: 1338 - protein, 378 aa, Homo Sapiens
MLPPQPSAAHQGRGGRSGLLPKGPAMLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 1339 - protein, 55 aa, Homo Sapiens
MLPPQPSAAHQGRGGRSGLLPKGWQDPLPQPSCWPMRVGSLMTSSSGTSLRTSST

SEQ ID NO: 1340 - protein, 121 aa, Homo Sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLL

SEQ ID NO: 1341 - protein, 384 aa, Homo Sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLERAGLAPSGHEGIRPFGVQLPGAQQSSFDPCMYRELLLVHRFAPYEMLLMWKALHSPALSCDRGHRVS

SEQ ID NO: 1342 - protein, 401 aa, Homo Sapiens
MSLWKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 1343 - protein, 397 aa, Homo Sapiens
MRCPKCLLCLSALLTLLGLKVYIEWTSESRLSKAYPSPRGTPPSPTPANPEPTLPANLSTRLGQTIPLPFAYWNQQQWRLGSLPSGDSTETGGCQAWGAAAATEIPDFASYPKDLRRFLLSAACRSFPQWLPGGGGSQVSSCSDTDVPYLLLAVKSEPGRFAERQAVRETWGSPAPGIRLLFLLGSPVGEAGPDLDSLVAWESRRYSDLLLWDFLDVPFNQTLKDLLLLAWLGRHCPTVSFVLRAQDDAFVHTPALLAHLRALPPASARSLYLGEVFTQAMPLRKPGGPFYVPESFFEGGYPAYASGGGYVIAGRLAPWLLRAAARVAPFPFEDVYTGLCIRALGLVPQAHPGFLTAWPADRTADHCAFRNLLLVRPLGPQASIRLWKQLQDPRLQC

SEQ ID NO: 1344 - protein, 402 aa, Homo Sapiens
MRRRLRLRRDALLTLLLGASLGLLLYAQRDGAAPTASAPRGRGRAAPRPTPGPRAFQLPDAGAAPPAYEGDTPAPPTPTGPFDFARYLRAKDQRRFPLLINQPHKCRGDGAPGGRPDLLIAVKSVAEDFERRQAVRQTWGAEGRVQGALVRRVFLLGVPRGAGSGGADEVGEGARTHWRALLRAESLAYADILLWAFDDTFFNLTLKEIHFLAWASAFCPDVRFVFKGDADVFVNVGNLLEFLAPRDPAQDLLAGDVIVHARPIRTRASKYYIPEAVYGLPAYPAYAGGGGFVLSGATLHRLAGACAQVELFPIDDVFLGMCLQRLRLTPEPHPAFRTFGIPQPSAAPHLSTFDPCFYRELVVVHGLSAADIWLMWRLLHGPHGPACAHPQPVAAGPFQWDS

SEQ ID NO: 1345 - protein, 96 aa, Homo Sapiens
MWLGRRALCALVLLLACASLGLLYASTRDAPGLRLPLAPWAPPQSPRRPELPDLAPEPRYAHIPVRIKEQVVGAEGCLCHKRAGVPGLSVEEPVPS

SEQ ID NO: 1346 - protein, 81 aa, Homo Sapiens
MWLGRRALCALVLLLACASLGLLYASTRDAPGLRLPLAPWAPPQSPRRPELPDLAPEPRYAHIPVRIKEQVVGLLAWNNCS

SEQ ID NO: 1347 - protein, 120 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQ

SEQ ID NO: 1348 - protein, 231 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGEPDCLPRHLGRGRGSDWSYSHWRGSGRSHPCQPRAGPTQQATTTGHLQQPKLPDQHSRHSPVLHRGT

SEQ ID NO: 1349 - protein, 237 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADT

SEQ ID NO: 1350 - protein, 304 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTAQYNISALVTIATKTFLRYDRLRALITSIRRFYPTVTVVIADDSDKPERVSGPYVEHYLMPFGKVCS

SEQ ID NO: 1351 - protein, 328 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGARPGWRDGQAGQTEKNQKGWSGQMAEGMGGIWAMARAVQPHNGCFNWTSRARGRKGAFVHLGLEQARGKPEPWVCLPFRPTVGGPRKRLV

SEQ ID NO: 1352 - protein, 328 aa, Homo Sapiens; identical to SEQ ID NO: 1351

SEQ ID NO: 1353 - protein, 533 aa, Homo Sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 1354 - protein, 478 aa, Homo Sapiens
MWLGRRALCALVLLLACASLGLLYASTRDAPGLRLPLAPWAPPQSPRRPELPDLAPEPRYAHIPVRIKEQVVGSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 1355 - protein, 151 aa, Homo Sapiens
  misc_feature (1)..(1): Xaa can be any naturally occurring amino acid
XMPFGKGWFAGRNLAVSQVTTKYVLWVDDDFVFTARTRLERLVDVLERTPLDLARLEATSLSLQVGGAVREISGFATTYRQLLSVEPGAPGLGNCLRQRRGFHHELVGFPGCVVTDGVVNFFLARTDKVREVGFDPRLSRVAHLEFFLDGL

SEQ ID NO: 1356 - protein, 127 aa, Homo Sapiens
  misc_feature (1)..(1): Xaa can be any naturally occurring amino acid
XSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGSNAMSFLPSPVLHRGT

SEQ ID NO: 1357 - protein, 637 aa, Homo Sapiens [sequence omitted]

SEQ ID NO: 1358 - protein, 998 aa, Homo Sapiens [sequence omitted]

SEQ ID NO: 1359 - protein, 53 aa, Homo Sapiens
DASSIVFLCDLHIHFPPNILDGIRKHCVEGRLAFAPVVMRLSCGSSPRDPHGS

SEQ ID NO: 1360 - protein, 26 aa, Homo Sapiens
DVERALRAARLPRDRACDSPSPGTST

SEQ ID NO: 1361 - protein, 1039 aa, Homo Sapiens
MPRLPVKKIRKQMKLLLLLLLLSCAAWLTYVHLGLVRQGRALRQRLGYGRDGEKLTSETDGRGVHAAPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQLVAFVGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLTPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQSPAPAAPAQPGATLAPPTPPRPRDGGTPRHSRALSWAARAARPLPLFLGRAPPPRPAVEQPPPKVYVTRVRPGQRASPRAPAPRAPWPPFPGVFLHPRPLPRVQLRAPPRPPRPHGRRTGGPQATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGRFALLRIVNVEKRRDSARGSRFLLELELQERGGGRLRLSEYVFLRLPGARVGDADGESPEPAPAASVRPDGRPELCRPLRLAWRQDVMVHFIVPVKNQARWVAQFLADMAALHARTGDSRFSVVLVDFESEDMDVERALRAARLPRYQYLRRTGNFERSAGLQAGVDAVEDASSIVFLCDLHIHFPPNILDGIRKHCVEGRLAFAPVVMRLSCGSSPRDPHGYWEVNGFGLFGIYKSDFDRVGGMNTEEFRDQWGGEDWELLDRVLQAGLEVERLRLRNFYHHYHSKRGMWSVRSRKGSRTGAS

SEQ ID NO: 1362 - protein, 62 aa, Homo Sapiens
MANFHKTLILGKGKTLTNEASTKKVELDNCPSVSPYLRGQSKLIFKPDLTLEEVQEIRLLNV

SEQ ID NO: 1363 - protein, 2 aa, Homo Sapiens
MG

SEQ ID NO: 1364 - protein, 6 aa, Homo Sapiens
MGFNLT

SEQ ID NO: 1365 - protein, 21 aa, Homo Sapiens
MGFNLTFHLSYKFRLLLLLTL

SEQ ID NO: 1366 - protein, 42 aa, Homo Sapiens
MGFNLTFHLSYKFRLLLLLTLCLTVVGWATSNYFVGAIQEIP

SEQ ID NO: 1367 - protein, 55 aa, Homo Sapiens
MGFNLTFHLSYKFRLLLLLTLCLTVVGWATSNYFVGAIQEIPKAKEFMANFHKTL

SEQ ID NO: 1368 - protein, 118 aa, Homo Sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQEC

SEQ ID NO: 1369 - protein, 136 aa, Homo Sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKH

SEQ ID NO: 1370 - protein, 246 aa, Homo Sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKG

SEQ ID NO: 1371 - protein, 344 aa, Homo Sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 1372 - protein, 344 aa, Homo Sapiens; identical to SEQ ID NO: 1371

SEQ ID NO: 1373 - protein, 344 aa, Homo Sapiens; identical to SEQ ID NO: 1371

SEQ ID NO: 1374 - protein, 301 aa, Homo Sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAER

SEQ ID NO: 1375 - protein, 25 aa, Homo Sapiens
MYLLEHLHPFLQRQQLDYGIYVIHQ

SEQ ID NO: 1376 - protein, 388 aa, Homo Sapiens
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 1377 - protein, 343 aa, Homo Sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 1378 - protein, 382 aa, Homo Sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 1379 - protein, 343 aa, Homo Sapiens
MSVLRRMMRVSNRSLLAFIFFFSLSSSCLYFIYVAPGIDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 1380 - protein, 72 aa, Homo Sapiens
MVQARGIMLRENVKTIGHMIRLYTNKNSTLNGTDYPEGNNSSDYLVQTTTYLPENFTYSPYLPCPEKLPYMR

SEQ ID NO: 1381 - protein, 415 aa, Homo Sapiens
MQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 1382 - protein, 92 aa, Homo Sapiens
IDVTFKSTNPYGWPQIVLSVYGPDVFGNDVVRGYGAVHVPFSPGRHKRTIPMFVPESTSKLQKFTSWFMGRRPEYTDPKVVAQGEGREAQPG

SEQ ID NO: 1383 - protein, 133 aa, Homo Sapiens
LLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 1384 - protein, 135 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTR

SEQ ID NO: 1385 - protein, 153 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSLCLVASSDLQAAPPTEDK

SEQ ID NO: 1386 - protein, 186 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAITAPRKAVFSVHGLTSPRALALVHIKGT

SEQ ID NO: 1387 - protein, 161 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAQPG

SEQ ID NO: 1388 - protein, 187 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREDENAEAEIPRSTWVSLCPSPAWLMLPFCPQ

SEQ ID NO: 1389 - protein, 183 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREGKAPSPLLPPSPIQVTAWEWVGPGLG

SEQ ID NO: 1390 - protein, 204 aa, Homo Sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 1391 - protein, 125 aa, Homo Sapiens
MATASPSVFLLMVNGQVESAQFPEYDDLYCKYCFVYGQDWAPTAGLEEGISQITSKSQDVRQALVWNFPIDVTFKSTNPYGYRAQRVWTRCVRERCGSRLWGRARALLTWPAQKDHPHVCPRIYV

SEQ ID NO: 1392 - protein, 19 aa, Homo Sapiens
MMTSTASTALCTARTGPPQ

SEQ ID NO: 1393 - protein, 106 aa, Homo Sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNC

SEQ ID NO: 1394 - protein, 133 aa, Homo Sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGK

SEQ ID NO: 1395 - protein, 147 aa, Homo Sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKPPSGLSVKDSSVSR

SEQ ID NO: 1396 - protein, 153 aa, Homo Sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKVKLPPLSYPHPPYRLQPGSG

SEQ ID NO: 1397 - protein, 213 aa, Homo Sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKVKLPPLSYPHPPYRLQPGSGWAQGWGECRGPARHIGASPQMFPDEGLVGAQRVCHVCLSRQPLYLPVRGLGQALLSPFYR

SEQ ID NO: 1398 - protein, 112 aa, Homo Sapiens
SNRARPRWVPPAPPDLPWRPRVLASFYSWSTGRWRAPSFQSMMTSTASTALCTARTGPPQRVWRRGSHRSHPRAKMCGKHWCGTSPLMSPLKAPTPTAAVQLAFWKFRVHQG

SEQ ID NO: 1399 - protein, 396 aa, Homo Sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 1400 - protein, 518 aa, Homo Sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 1401 - protein, 468 aa, Homo Sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 1402 - protein, 43 aa, Homo Sapiens
MAAGAVFLALSAQLLQARLMKEESPVVSWRLEPEDGTALCFIF

SEQ ID NO: 1403 - protein, 628 aa, Homo Sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 1404 - protein, 588 aa, Homo Sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAP

SEQ ID NO: 1405 - protein, 286 aa, Homo Sapiens
MEPPDAPAQARGAPRLLLLAVLLAAHPDAQAEVRLSVPPLVEVMRGKSVILDCTPTGTHDHYMLEWFLVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQ

SEQ ID NO: 1406 - protein, 61 aa, Homo Sapiens
  misc_feature (1)..(1): Xaa can be any naturally occurring amino acid
XGYMTSRTVREASGLLSLTSTLYLRLRKDDRDASFHCAAHYSLPEGRHGRLDSPTFHLTLH

SEQ ID NO: 1407 - protein, 145 aa, Homo Sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDD

SEQ ID NO: 1408 - protein, 196 aa, Homo Sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGIPSRPHERPVTETWMASPGSGTMVWWTRMTSMMCTVMLKT

SEQ ID NO: 1409 - protein, 213 aa, Homo Sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTV

SEQ ID NO: 1410 - protein, 911 aa, Homo Sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 1411 - protein, 671 aa, Homo Sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 1412 - protein, 231 aa, Homo Sapiens
MAQLFLPLLAALVLAQAPAALADVLEGDSSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLF

SEQ ID NO: 1413 - protein, 26 aa, Homo Sapiens
  misc_feature (1)..(1): Xaa can be any naturally occurring amino acid
XHGIDDSSDAVEVKVKGGGHSTHNLT

SEQ ID NO: 1414 - protein, 294 aa, Homo Sapiens
IATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKQREILPHRRGESTVTTEAEIGVMEPQQRNADSHQKLEEAKNRFFPRASSSRSMALQIPIKLILDFLASRTMGINLLFQAIKFVIICYCCHSKLIQEHAGQICNGLN

SEQ ID NO: 1415 - protein, 147 aa, Homo Sapiens
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 1416 - protein, 64 aa, Homo Sapiens
MTLQWAAVATFLYAEIGLILIFCLPFIPPQRWQKIFSFNVWGKIATFWNKAFLTIIILLIVLFL

SEQ ID NO: 1417 - protein, 133 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSN

SEQ ID NO: 1418 - protein, 171 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRFLLAKVHCRKL

SEQ ID NO: 1419 - protein, 196 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSD

SEQ ID NO: 1420 - protein, 230 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQ

SEQ ID NO: 1421 - protein, 241 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 1422 - protein, 241 aa, Homo Sapiens; identical to SEQ ID NO: 1421

SEQ ID NO: 1423 - protein, 348 aa, Homo Sapiens
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQHSSFGEFLSKRSHKNGSIGKQTGSRKGSFRKRQQEKTVNFIKDTCNILCQNDNFVMLASRKFKFRKMHYDRFVIFLMPHIGCIVMALSKYLMMFQIYCKVCIPALKKNISMLNTIFTY

SEQ ID NO: 1424 - protein, 348 aa, Homo Sapiens; identical to SEQ ID NO: 1423

SEQ ID NO: 1425 - protein, 66 aa, Homo Sapiens
MTLQWAAVATFLYAEIGLILIFCLPFIPPQRWQKIFSFNVWGKIATFWNKAFLTIIILLIVLFLEF

SEQ ID NO: 1426 - protein, 163 aa, Homo Sapiens
  misc_feature (1)..(1): Xaa can be any naturally occurring amino acid
XDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKSHSQPGAAAFLVKEVESF

SEQ ID NO: 1427 - protein, 868 aa, Homo Sapiens
MENVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1428 - protein, 888 aa, Homo Sapiens
MHCPGEAPLAAPRPTPKDPCLRNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1429 - protein, 888 aa, Homo Sapiens
MLTHRPQEAEQRGRTPGPSFEWNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1430 - protein, 870 aa, Homo Sapiens
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1431 - protein, 888 aa, Homo Sapiens
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVSKCQGNARARLRLWGVWVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1432 - protein, 916 aa, Homo Sapiens
MPAKPFLSSVLLSWKVLDFSGPGPQGTGQPCSCGHWAEGQGGPPEPAGGPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1433 - protein, 57 aa, Homo Sapiens
MPAKPFLSSVLLSWKVLDFSGPGPQGTGQPCSCGHWAEGQGGPPEPAGGPVSQGSSD

SEQ ID NO: 1434 - protein, 57 aa, Homo Sapiens; identical to SEQ ID NO: 1433

SEQ ID NO: 1435 - protein, 722 aa, Homo Sapiens
MQGKNVLAKALYDNVAESPDELSFRKGDIMTVLEQDTQGLDGWWLCSLHGRQGIVPGNRLKILVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1436 - protein, 870 aa, Homo Sapiens
MSVPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 1437 - protein, 50 aa, Homo Sapiens
MTVLEQDTQGLDGWWLCSLHGRQGIVPGNRLKILVGMYDKKPAGPGPGPP

SEQ ID NO: 1438 - protein, 59 aa, Homo Sapiens
MTVLEQDTQGLDGWWLCSLHGRQGIVPGNRLKILVGMYDKKPAGPGPGPPATPAQPQPG

SEQ ID NO: 1439 - protein, 80 aa, Homo Sapiens
MTVLEQDTQGLDGWWLCSLHGRQGIVPGNRLKILVGMYDKKPAGPGPGPPATPAQPQPGLHAPAPPASQYTPMLPNTYQP

SEQ ID NO: 1440 - protein, 120 aa, Homo Sapiens
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFS

SEQ ID NO: 1441 - protein, 128 aa, Homo Sapiens
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPF

SEQ ID NO: 1442 - protein, 133 aa, Homo Sapiens
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPAT

SEQ ID NO: 1443 - protein, 135 aa, Homo Sapiens
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDL

SEQ ID NO: 1444 - protein, 238 aa, Homo Sapiens
  misc_feature (1)..(1): Xaa can be any naturally occurring amino acid
XPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVY

SEQ ID NO: 1445 - protein, 120 aa, Homo Sapiens
AVQFTGWSSSCILHFPEVLHDFHSLQTLPSLLQRIGNPNETQNNSTSWPVFKSTEQKYLTLNTESTRIMTKLRAQQCRFWTSFFPKVLEMTEPICCYCEPGTALAARAAQMKMTGSAYSQ

SEQ ID NO: 1446 - protein, 132 aa, Homo Sapiens
AVQFTGWSSSCILHFPEVLHDFHSLQTLPSLLQRIGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 1447 - protein, 602 aa, Homo Sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 1448 - protein, 525 aa, Homo Sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGCSSSTILNYVLETEPVVLI

SEQ ID NO: 1449 - protein, 562 aa, Homo Sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTG

SEQ ID NO: 1450 - protein, 218 aa, Homo Sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKIKVISLS

SEQ ID NO: 1451 - protein, 392 aa, Homo Sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 1452 - protein, 392 aa, Homo Sapiens; identical to SEQ ID NO: 1451

SEQ ID NO: 1453 - protein, 329 aa, Homo Sapiens
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1454 - protein, 77 aa, Homo Sapiens
MCGATSFLHECTRLILVTTQNAEFLQKGLQVHTCFGVYPHASVWHDCASQKKGCAVYLHVSVEFNKLIPENGFIKGW

SEQ ID NO: 1455 - protein, 255 aa, Homo Sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1456 - protein, 262 aa, Homo Sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1457 - protein, 247 aa, Homo Sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1458 - protein, 247 aa, Homo Sapiens; identical to SEQ ID NO: 1457

SEQ ID NO: 1459 - protein, 247 aa, Homo Sapiens; identical to SEQ ID NO: 1457

SEQ ID NO: 1460 - protein, 247 aa, Homo Sapiens; identical to SEQ ID NO: 1457

SEQ ID NO: 1461 - protein, 247 aa, Homo Sapiens; identical to SEQ ID NO: 1457

SEQ ID NO: 1462 - protein, 247 aa, Homo Sapiens; identical to SEQ ID NO: 1457

SEQ ID NO: 1463 - protein, 247 aa, Homo Sapiens; identical to SEQ ID NO: 1457

SEQ ID NO: 1464 - protein, 247 aa, Homo Sapiens; identical to SEQ ID NO: 1457

SEQ ID NO: 1465 - protein, 247 aa, Homo Sapiens; identical to SEQ ID NO: 1457

SEQ ID NO: 1466 - protein, 247 aa, Homo Sapiens; identical to SEQ ID NO: 1457

SEQ ID NO: 1467 - protein, 247 aa, Homo Sapiens; identical to SEQ ID NO: 1457

SEQ ID NO: 1468 - protein, 247 aa, Homo Sapiens; identical to SEQ ID NO: 1457

SEQ ID NO: 1469 - protein, 247 aa, Homo Sapiens; identical to SEQ ID NO: 1457

SEQ ID NO: 1470 - protein, 247 aa, Homo Sapiens; identical to SEQ ID NO: 1457

SEQ ID NO: 1471 - protein, 100 aa, Homo Sapiens
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 1472 - protein, 368 aa, Homo Sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 1473 - protein, 238 aa, Homo Sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYVRSWEEPAGLQQRAGVRALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLT

SEQ ID NO: 1474 - protein, 121 aa, Homo Sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKLSCSGTLPRCPHDCRL

SEQ ID NO: 1475 - protein, 206 aa, Homo Sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 1476 - protein, 163 aa, Homo Sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSGDQPLTGAYTVTLDGRGPSRVISKHDLGHFMLRCLTTDEYDGHSTYPSHQYQ

SEQ ID NO: 1477 - protein, 154 aa, Homo Sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSGGWWDHGGGAELGGTGEAAQGPLKGDAEAIPCYCAFTEHQLCA

SEQ ID NO: 1478 - protein, 245 aa, Homo Sapiens
MAVKKIAIFGATGQTGLTTLAQAVQAGYEVTVLVRDSSRLPSEGPRPAHVVVGDVLQAADVDKTVAGQDAVIVLLGTRNDLSTEPPLCPRPSPTPRPPAPPPPPAPPLPPLPPPPPTSDSHSLSPLRSHDSDVRGRPEHCGSHEGSWCGQAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 1479 - protein, 730 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1480 - protein, 986 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1481 - protein, 622 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 1482 - protein, 717 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSGGELFGLLGHPPRRP

SEQ ID NO: 1483 - protein, 730 aa, Homo Sapiens; identical to SEQ ID NO: 1479

SEQ ID NO: 1484 - protein, 302 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSIHQALCWTGLFLRPSPFPRLPLAAPRTLRAGV

SEQ ID NO: 1485 - protein, 302 aa, Homo Sapiens; identical to SEQ ID NO: 1484

SEQ ID NO: 1486 - protein, 189 aa, Homo Sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGSGPPP

SEQ ID NO: 1487 - protein, 189 aa, Homo Sapiens; identical to SEQ ID NO: 1486

SEQ ID NO: 1488 - protein, 189 aa, Homo Sapiens; identical to SEQ ID NO: 1486

SEQ ID NO: 1489 - protein, 189 aa, Homo Sapiens; identical to SEQ ID NO: 1486

SEQ ID NO: 1490 - protein, 61 aa, Homo Sapiens
MPGVARLPLLLGLLLLPRPGRPLDLADYTYDLAEEDDSEPLNYKDPCKLPFLGTLPWTKRT

SEQ ID NO: 1491 - protein, 424 aa, Homo Sapiens
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 1492 - protein, 392 aa, Homo Sapiens
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 1493 - protein, 396 aa, Homo Sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 1494 - protein, 472 aa, Homo Sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 1495 - protein, 104 aa, Homo Sapiens
LIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEASLRTR

SEQ ID NO: 1496 - protein, 271 aa, Homo Sapiens
MFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQA

SEQ ID NO: 1497 - protein, 110 aa, Homo Sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERP

SEQ ID NO: 1498 - protein, 408 aa, Homo Sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 1499 - protein, 408 aa, Homo Sapiens; identical to SEQ ID NO: 1498

SEQ ID NO: 1500 - protein, 408 aa, Homo Sapiens; identical to SEQ ID NO: 1498

SEQ ID NO: 1501 - protein, 408 aa, Homo Sapiens; identical to SEQ ID NO: 1498

SEQ ID NO: 1502 - protein, 29 aa, Homo Sapiens
NTVRSFHHEGQSLPPVCVGEGWWDWLEGQ

SEQ ID NO: 1503 - protein, 513 aa, Homo Sapiens
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 1504 - protein, 365 aa, Homo Sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 1505 - protein, 431 aa, Homo Sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 1506 - protein, 412 aa, Homo Sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVGVTPSWGVVTWAGQAAGPPDPAASKLGPE

SEQ ID NO: 1507 - protein, 297 aa, Homo Sapiens
  misc_feature (1)..(1): Xaa can be any naturally occurring amino acid
XPPLASLQDSHFLTDADMVMSFVNLVEHDKEFFHPRYHHREFRFDLSKIPEGEAVTAAEFRIYKDYIRERFDNETFRISVYQVLQEHLGSTGTCCMPCLRASTRTNQTRVPALWKLTFQQRRGHGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATN

SEQ ID NO: 1508 - protein, 402 aa, Homo Sapiens
MAARPGPLWLLGLTLCALGGGGPGLRPPPGCPQRRLGARERRDVQREILAVLGLPGRPRPRAPPAASRLPASAPLFMLDLYHAMAGDDDEDGAPAEQRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVRGSHGRQVCRRHELYVSFQDLGWLDWVIAPQGYSAYYCEGECSFPLDSCMNATNHAILQSLVHLMKPNAVPKACCAPTKLSATSVLYYDSSNNVILRKHRNMVVKACGCH

SEQ ID NO: 1509 - protein, 402 aa, Homo Sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 1510 - protein, 90 aa, Homo Sapiens
MLWFSGVGALAERYCRRSPGITCCVLLLLNCSGVPMSLASSFLTGSVAKCENEGEVLQIPFITDNPCIMCVCLHEPTRWSNLTQNPGFYD

SEQ ID NO: 1511 - protein, 685 aa, Homo Sapiens
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVVHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSCVTDMCECPVHKNCYCESFLAYTRACQREGIKVHWEPQQNCAATQCKHGAVYDTCGPGCIKTCDNWNEIGPCNKPCVAGCHCPANLVLHKGRCIKPVLCPQR

SEQ ID NO: 1512 - protein, 133 aa, Homo Sapiens
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKVLVSRVLRDTVLFTLKYWRLPVFWLHL

SEQ ID NO: 1513 - protein, 161 aa, Homo Sapiens
MLWFSGVGALAERYCRRSPGITCCVLLLLNCSGVPMSLASSFLTGSVAKCENEGEVLQIPFITDNPCIMCVCLVAPMKEIPITAPSNGRARLSLVFYASARRALSQSLGCAVLFIVKTLWSIWECAAPHVQAVCLRVCSIKKGRNFSQKEANVPSVPALEA

SEQ ID NO: 1514 - protein, 987 aa, Homo Sapiens
MRCRNMFFSFKASLCGCGAATAPSLTAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 1515 - protein, 994 aa, Homo Sapiens
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 1516 - protein, 22 aa, Homo Sapiens
MLRGTMTAWRGMRPEVTLACLL

SEQ ID NO: 1517 - protein, 32 aa, Homo Sapiens
MLRGTMTAWRGMRPEVTLACLLLATAGCFADL

SEQ ID NO: 1518 - protein, 85 aa, Homo Sapiens
MLRGTMTAWRGMRPEVTLACLLLATAGCFADLNEVPQVTVQPASTVQKPGGTVILGCVVEPPRMNVTWRLNGKELNGSDDALGVL

SEQ ID NO: 1519 - protein, 1115 aa, Homo Sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKQVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 1520 - protein, 1114 aa, Homo Sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 1521 - protein, 1114 aa, Homo Sapiens; identical to SEQ ID NO: 1520

SEQ ID NO: 1522 - protein, 157 aa, Homo Sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 1523 - protein, 157 aa, Homo Sapiens; identical to SEQ ID NO: 1522

SEQ ID NO: 1524 - protein, 65 aa, Homo Sapiens
MTHEVLSTFIPSEGSSSKVEEVDLQDFKLDVQHVIEVDEGNTAVIACHLPESHPKAQVRYSVKQE

SEQ ID NO: 1525 - protein, 39 aa, Homo Sapiens
  misc_feature (1)..(1): Xaa can be any naturally occurring amino acid
XQQQSDTSSLLRQTHLGNGYDPQSHQITRAPMLLGPCAS

SEQ ID NO: 1526 - protein, 84 aa, Homo Sapiens
  misc_feature (1)..(1): Xaa can be any naturally occurring amino acid
XRACANGIHMNRGCPSAAVGYPGMKPQQHCPGELQQQSDTSSLLRQTHLGNGYDPQSHQITSCCSPITTAANARSSLLLWASQG

SEQ ID NO: 1527 - protein, 85 aa, Homo Sapiens
MADGGGGGGTGAVGGGGTSQASAGAATGATGASGGGGPINPASLPPGDPQLIALIVEQLKSRGLFDSFRRDCLADVDTKNTPDTF

SEQ ID NO: 1528 - protein, 129 aa, Homo Sapiens
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQIRQTPFES

SEQ ID NO: 1529 - protein, 185 aa, Homo Sapiens
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 1530 - protein, 42 aa, Homo Sapiens
MNKNQLRNGLRQSVVQSGMLEAGVDRIISQVVDPKLNHIFRP

SEQ ID NO: 1531 - protein, 118 aa, Homo Sapiens
  misc_feature (1)..(1): Xaa can be any naturally occurring amino acid
XLALLGPAGAVAPSTRPRCLPATRSSSLSSWSSSRAGAFLTASAGTAWPTWTPRSGMLEAGVDRIISQVVDPKLNHIFRPQIERAIHEFLAAQKKAAVPAPPPEPEGQDPPAPSQDTS

SEQ ID NO: 1532 - protein, 137 aa, Homo Sapiens
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 1533 - protein, 137 aa, Homo Sapiens; identical to SEQ ID NO: 1532

SEQ ID NO: 1534 - protein, 137 aa, Homo Sapiens; identical to SEQ ID NO: 1532

SEQ ID NO: 1535 - protein, 55 aa, Homo Sapiens
MENVCEKVTNSVSSELQPYFQTLPVMTKIDSVAGINYGLVAPPATTAETLDVQMK

SEQ ID NO: 1536 - protein, 286 aa, Homo Sapiens
MENVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 1537 - protein, 487 aa, Homo Sapiens
MRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 1538 - protein, 261 aa, Homo Sapiens
MTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 1539 - protein, 242 aa, Homo Sapiens
MFQTGGLIVFYGLLAQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 1540 - protein, 256 aa, Homo Sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 1541 - protein, 256 aa, Homo Sapiens; identical to SEQ ID NO: 1540

SEQ ID NO: 1542 - protein, 256 aa, Homo Sapiens; identical to SEQ ID NO: 1540

SEQ ID NO: 1543 - protein, 249 aa, Homo Sapiens
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 1544 - protein, 249 aa, Homo Sapiens; identical to SEQ ID NO: 1543

SEQ ID NO: 1545 - protein, 218 aa, Homo Sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESRSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 1546 - protein, 254 aa, Homo Sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 1547 - protein, 147 aa, Homo Sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSA

SEQ ID NO: 1548 - protein, 484 aa, Homo Sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 1549 - protein, 458 aa, Homo Sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 1550 - protein, 476 aa, Homo Sapiens
MQPVMLALWSLLLLWGLATPCQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 1551 - protein, 614 aa, Homo Sapiens
MWMAWCVAALSVVAVCGTSHETNTVLRVTKDVLSNAISGMLQQSDALHSALREVPLGVGDIPYNDFHVRGPPPVYTNGKKLDGIYQYGHIETNDNTAQLGGKYRYGEILESEGSIRDLRNSGYRSAENAYGGHRGLGRYRAAPVGRLHRRELQPGEIPPGVATGAVGPGGLLGTGGMLAADGILAGQGGLLGGGGLLGDGGLLGGGGVLGVLGEGGILSTVQGITGLRIVELTLPRVSVRLLPGVGVYLSLYTRVAINGKSLIGFLDIAVEVNITAKVRLTMDRTGYPRLVIERCDTLLGGIKVKLLRGLLPNLVDNLVNRVLADVLPDLLCPIVDVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGMFEELPPLTTATLGALIPKVFQQYPESCPLIIRIQVLNPPSVMLQKDKALVKVLATAEVMVSQPKDLETTICLIDVDTEFLASFSTEGDKLMIDAKLEKTSLNLRTSNVGNFDIGLMEVLVEKIFDLAFMPAMNAVLGSGVPLPKILNIDFSNADIDVLEDLLVLSA

SEQ ID NO: 1552 - protein, 44 aa, Homo Sapiens
MWMAWCVAALSVVAVCGTSHETNTVLRVTKDVLSNGFSPISWTI

SEQ ID NO: 1553 - protein, 453 aa, Homo Sapiens
MLRILCLALCSLLTGTRADPGALLRLGMDIMNQVQSAMDESHILEKMAAEAGKKQPGMKPIKGITNLKVKDVQLPVITLNFVPGVGIFQCVSTGMTVTGKSFMGGNMEIIVALNITATNRLLRDEETGLPVFKSEGCEVILVNVKTNLPSNMLPKMVNKFLDSTLHKVLPGLMCPAIDAVLVYVNRKWTNLSDPMPVGQMGTVKYVLMSAPATTASYIQLDFSPVVQQQKGKTIKLADAGEALTFPEGYAKGSSQLLLPATFLSAELALLQKSFHVNIQDTMIGELPPQTTKTLARFIPEVAVAYPKSKPLTTQIKIKKPPKVTMKTGKSLLHLHSTLEMFAARWRSKAPMSLFLLEVHFNLKVQYSVHENQLQMATSLDRLLSLSRKSSSIGNFNERELTGFITSYLEEAYIPVVNDVLQVGLPLPDFLAMNYNLAELDIVENALMLDLKLG

SEQ ID NO: 1554 - protein, 88 aa, Homo Sapiens
MLRILCLALCSLLTGTRADPGALLRLGMDIMNREVQSAMDESHILEKMAAEAGKKQPGMKPIKGITNEQGHFEEEMRLESQISTLHAT

SEQ ID NO: 1555 - protein, 82 aa, Homo Sapiens
MCTKTIPVLWGCFLLWNLYVSSSQTIYPGIKARITQRALDYGVQAGMKMIEQMLKEKKLPDLSGSESLEFLKVDYVNYNFSK

SEQ ID NO: 1556 - protein, 507 aa, Homo Sapiens
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFQDTGGADLFLSGVYFTGIIILTRNDFGHPTLKLQDCYAQLSHAHVSFSGELSVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 1557 - protein, 507 aa, Homo Sapiens; identical to SEQ ID NO: 1556

SEQ ID NO: 1558 - protein, 264 aa, Homo Sapiens
MEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 1559 - protein, 64 aa, Homo Sapiens
MAVSRHLTRGRKMAHVIAACLYLVCRTEGTPHMLLDLSDLLQVNVYVLGKTFLLLARELCINAP

SEQ ID NO: 1560 - protein, 562 aa, Homo Sapiens
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1561 - protein, 584 aa, Homo Sapiens
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRRDLSMPRCAKAKSQPHFPVLAQYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1562 - protein, 439 aa, Homo Sapiens
MHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1563 - protein, 14 aa, Homo Sapiens
MTALRLLQRMKRDW

SEQ ID NO: 1564 - protein, 45 aa, Homo Sapiens
MTALRLLQRMKRDWMHTGRRPSGLCGAALLVAARMHDFRRTVKEV

SEQ ID NO: 1565 - protein, 134 aa, Homo Sapiens [sequence omitted]

SEQ ID NO: 1566 - protein, 184 aa, Homo Sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSPPSRREGRRRPESLPRPLRGKAPVPLVGGLSSGMAAPDVAEGASPCVLRRGWP

SEQ ID NO: 1567 - protein, 155 aa, Homo Sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSL

SEQ ID NO: 1568 - protein, 234 aa, Homo Sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDP

SEQ ID NO: 1569 - protein, 473 aa, Homo Sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1570 - protein, 161 aa, Homo Sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAPHRGGRADGGPRASPGLFVGRPQYHS

SEQ ID NO: 1571 - protein, 208 aa, Homo Sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVDSLRPASFPTWGCDLGVVTRVVTGVYPRCLHASQWPVCAACPVRKFWSVG

SEQ ID NO: 1572 - protein, 677 aa, Homo Sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1573 - protein, 650 aa, Homo Sapiens
MTGRVCRGCGGTDIELDAARGDAVCTACGSVLEDNIIVSEVQFVESSGGGSSAVGQFVSLDGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 1574 - protein, 185 aa, Homo Sapiens
  misc_feature (1)..(1): Xaa can be any naturally occurring amino acid
XGQFVSLDGAGKTPTLGGGFHVNLGKESRAQTLQNDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIE

SEQ ID NO: 1575 - protein, 761 aa, Homo Sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 1576 - protein, 320 aa, Homo Sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSGRESHSVPLHEWP

SEQ ID NO: 1577 - protein, 783 aa, Homo Sapiens
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 1578 - protein, 28 aa, Homo Sapiens
MIWRSRAGAELFSLMALWEWIALSLHCW

SEQ ID NO: 1579 - protein, 158 aa, Homo Sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSK

SEQ ID NO: 1580 - protein, 766 aa, Homo Sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 1581 - protein, 385 aa, Homo Sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1582 - protein, 55 aa, Homo Sapiens
MAAALFVLLGFALLGTHGASGAAGTVFTTVEDLGSKILLTCSLNDSATEQRAAPE

SEQ ID NO: 1583 - protein, 132 aa, Homo Sapiens
MAAALFVLLGFALLGTHGASGAAGTVFTTVEDLGSKILLTCSLNDSATEVTGHRWLKGGVVLKEDALPGQKTEFKAPTRPSSRSACAATWPPSGPSWASWLRCWCWSPSSSSTRSAGSPRTSWMMTTPALHP

SEQ ID NO: 1584 - protein, 269 aa, Homo Sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1585 - protein, 161 aa, Homo Sapiens [sequence omitted]

SEQ ID NO: 1586 - protein, 189 aa, Homo Sapiens
MAAALFVLLGFALLGTHGASGAGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1587 - protein, 221 aa, Homo Sapiens
MAAALFVLLGFALLGTHGASGAVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVT

SEQ ID NO: 1588 - protein, 52 aa, Homo Sapiens
MGTANIQLHGPPRVKAVKSSEHINEGETAMLVCKSESVPPVTDWAWYKITDS

SEQ ID NO: 1589 - protein, 84 aa, Homo Sapiens
MGTANIQLHGPPRVKAVKSSEHINEGETAMLVCKSESVPPVTDWAWYKITDSEDKALMNGSESRFFVSSSQGRSELHIENLNME

SEQ ID NO: 1590 - protein, 176 aa, Homo Sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1591 - protein, 205 aa, Homo Sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1592 - protein, 132 aa, Homo Sapiens
MGSLMLLFVETTRNSSACIFPVILNELSSTVETITHFPEVTDGECVFPFHYKNGTYYDCIKSKARHKWCSLNKTYEGYWKFCSAEDFANCVFPFWYRRLIYWECTDDGEAFGKKWCSLTKNFNKDRIWKYCE

SEQ ID NO: 1593 - protein, 155 aa, Homo Sapiens
GLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSPKRLCGTLGVRPRAEPYNRRF

SEQ ID NO: 1594 - protein, 318 aa, Homo Sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 1595 - protein, 333 aa, Homo Sapiens
MAAQGCAASRLLQLLLQLLLLLLLLAAGGARARWRGEGTSAHLRDIFLGRCAEYRALLSPEQRQIRNSREPPVLHTTQNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 1596 - protein, 97 aa, Homo Sapiens
  misc_feature (1)..(1): Xaa can be any naturally occurring amino acid
XSEPTGAYPIKGFFADYEIPNLQKEKITRIEIWVMHEIGGPNVESCGEGSMKVLEKRLKDMGFQYSCINDYRPVKLLQCVDHSTHPDCALKSKLWEP

SEQ ID NO: 1597 - protein, 186 aa, Homo Sapiens
  misc_feature (1)..(1): Xaa can be any naturally occurring amino acid
XSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSDGVSPC

SEQ ID NO: 1598 - protein, 478 aa, Homo Sapiens
MPRRGYSKPGSWGSFWAMLTLVGLVTHAAQRADVGGEAAGTSINHSQAVLQRLQELLRQGNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLVRHAYSFHQSSEEAGDFLAHADLQRRNSEYLVENALHLHLIVKPVYHTLIRTPK

SEQ ID NO: 1599 - protein, 179 aa, Homo Sapiens
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVIPAFFLSRLRVHRGDLSQGPEAVTC

SEQ ID NO: 1600 - protein, 543 aa, Homo Sapiens
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 1601 - protein, 545 aa, Homo Sapiens
MARKETQLIIKMNHLARFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 1602 - protein, 545 aa, Homo Sapiens
MPEGGGTSRRLLPMQSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 1603 - protein, 159 aa, Homo Sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVIPAFFLSRLRVHRGDLSQGPEAVTC

SEQ ID NO: 1604 - protein, 251 aa, Homo Sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTA

SEQ ID NO: 1605 - protein, 523 aa, Homo Sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 1606 - protein, 523 aa, Homo Sapiens; identical to SEQ ID NO: 1605

SEQ ID NO: 1607 - protein, 523 aa, Homo Sapiens; identical to SEQ ID NO: 1605

SEQ ID NO: 1608 - protein, 523 aa, Homo Sapiens; identical to SEQ ID NO: 1605

SEQ ID NO: 1609 - protein, 56 aa, Homo Sapiens
FIIFMAVSICCIKKLQREKKILSGEKKVEQEEKEIAQQLQEELRWRRTFLHAGECL

SEQ ID NO: 1610 - protein, 96 aa, Homo Sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEY

SEQ ID NO: 1611 - protein, 256 aa, Homo Sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAESFMPSASPWMVALAVILTASPWMVSMTVILAVFIIFMAVSICCIKKLQREKKILSGEKKVEQEEKEIAQQLQEELRWRRTFLHAGYELPGIRGPSWKRPLHGEPPSAF

SEQ ID NO: 1612 - protein, 239 aa, Homo Sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIF

SEQ ID NO: 1613 - protein, 523 aa, Homo Sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 1614 - protein, 336 aa, Homo Sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHADVNLTGLRNT

SEQ ID NO: 1615 - protein, 523 aa, Homo Sapiens; identical to SEQ ID NO: 1613

SEQ ID NO: 1616 - protein, 313 aa, Homo Sapiens
MEPAAALHFSLPASLLLLLLLLLLSLCALVSESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 1617 - protein, 110 aa, Homo Sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVN

SEQ ID NO: 1618 - protein, 184 aa, Homo Sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEK

SEQ ID NO: 1619 - protein, 407 aa, Homo Sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 1620 - protein, 39 aa, Homo Sapiens
MEPAAALHFSLPASLLLLLLLLLLSLCALVSVLPRSVCV

SEQ ID NO: 1621 - protein, 80 aa, Homo Sapiens
MVTTAVIIRDKYVRNVSCSVNNTLLGQEKETVIFIPESFMPSASPWMVALAVILTASPWMVSMTVILAVFIIFMAVSICC

SEQ ID NO: 1622 - protein, 237 aa, Homo Sapiens
MVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKES

SEQ ID NO: 1623 - protein, 43 aa, Homo Sapiens
MKMASFLAFLLLNFRVCLLLLQLLMPHSAQFSVLGPSGPILAM

SEQ ID NO: 1624 - protein, 92 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAP

SEQ ID NO: 1625 - protein, 119 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTAS

SEQ ID NO: 1626 - protein, 513 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 1627 - protein, 352 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGEEMLQMRLHFVK

SEQ ID NO: 1628 - protein, 378 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGPPIGQTQQQTRGQGSPVALSQESAQRTDSWGPEEGGES

SEQ ID NO: 1629 - protein, 461 aa, Homo Sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 1630 - protein, 311 aa, Homo Sapiens
MGIPRAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 1631 - protein, 334 aa, Homo Sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 1632 - protein, 334 aa, Homo Sapiens; identical to SEQ ID NO: 1631

SEQ ID NO: 1633 - protein, 334 aa, Homo Sapiens; identical to SEQ ID NO: 1631

SEQ ID NO: 1634 - protein, 334 aa, Homo Sapiens; identical to SEQ ID NO: 1631

SEQ ID NO: 1635 - protein, 160 aa, Homo Sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVADPFFRSAQPWIAALAG

SEQ ID NO: 1636 - protein, 43 aa, Homo Sapiens
MKMASSLAFLLLNFHVSLLLVQLLTPCSGLCSPLGSLYLAFPV

SEQ ID NO: 1637 - protein, 115 aa, Homo Sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGY

SEQ ID NO: 1638 - protein, 196 aa, Homo Sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIA

SEQ ID NO: 1639 - protein, 292 aa, Homo Sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 1640 - protein, 115 aa, Homo Sapiens
RGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTREWL

SEQ ID NO: 1641 - protein, 138 aa, Homo Sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKAL

SEQ ID NO: 1642 - protein, 238 aa, Homo Sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIA

SEQ ID NO: 1643 - protein, 584 aa, Homo Sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 1644 - protein, 127 aa, Homo Sapiens
MKMASSLAFLLLNFHVSLFLVQLLTPCSDADLPCHLFPTMSAETMELRWVSSSLRQVVNVYADGKEVEDRQSAPYRGRTSILRDGITAGKAALRIHNVTASDSGKYLCYFQDGDFYEKALVELKVAA

SEQ ID NO: 1645 - protein, 100 aa, Homo Sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELK

SEQ ID NO: 1646 - protein, 140 aa, Homo Sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDT

SEQ ID NO: 1647 - protein, 250 aa, Homo Sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKE

SEQ ID NO: 1648 - protein, 535 aa, Homo Sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 1649 - protein, 210 aa, Homo Sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAEWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKK

SEQ ID NO: 1650 - protein, 270 aa, Homo Sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 1651 - protein, 81 aa, Homo Sapiens
MRLLVLSSLLCILLLCFSIFSTEGKRRPAKAWSGRRTRLCCHRVPSPNSTNLKGHHVRLCKPCKLEPEPRLWVVPGALPQV

SEQ ID NO: 1652 - protein, 121 aa, Homo Sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQDLSESLTGSQDINLNWILPDTNAQKSQLT

SEQ ID NO: 1653 - protein, 150 aa, Homo Sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 1654 - protein, 142 aa, Homo Sapiens
MEQPSKDFCDSHKKSSKSSTYSASSYSSSGKRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGH

SEQ ID NO: 1655 - protein, 104 aa, Homo Sapiens
MSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 1656 - protein, 190 aa, Homo Sapiens
MVIWVILSLLGELGKPGLLTSLKNMEQPSKDFCDSHKKSSKSSTYSASSYSSSGKRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 1657 - protein, 25 aa, Homo Sapiens
MWTALVLIWIFSLSLSESHAASNDP

SEQ ID NO: 1658 - protein, 114 aa, Homo Sapiens
MWTALVLIWIFSLSLSESHAASNDPRNFVPNKMWKGLVKRNASVETVDNKTSEDVTMAAASPVTLTKGTSAAHLNSMEVTTEDTSRTDAYESYKKKDYTQVDYLINGMYADSEM

SEQ ID NO: 1659 - protein, 449 aa, Homo Sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 1660 - protein, 145 aa, Homo Sapiens
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 1661 - protein, 145 aa, Homo Sapiens; identical to SEQ ID NO: 1660

SEQ ID NO: 1662 - protein, 98 aa, Homo Sapiens
MVLAMLGALHPRAGLSLFLHLILAVALLRSQPLRSQRSVPEAFSAPLELSQPLSGLVDDYGILPKHPRPRGPRPLLSRAQQRKRDGPDLAEYYYDAHL

SEQ ID NO: 1663 - protein, 376 aa, Homo Sapiens
MGHQFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 1664 - protein, 301 aa, Homo Sapiens
MLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 1665 - protein, 213 aa, Homo Sapiens
MYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 1666 - protein, 130 aa, Homo Sapiens
  misc_feature (1)..(1): Xaa can be any naturally occurring amino acid
XMVGTLYDKVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 1667 - protein, 46 aa, Homo Sapiens
MAVEDHFELCLAKCRTSSQSVQHENTYRDPIAKYCYGESPPELFPA

SEQ ID NO: 1668 - protein, 47 aa, Homo Sapiens
MVNLAAMVWRRLLRKRWVLALVFGLSLVYFLSSTFKQATFARGRICW

SEQ ID NO: 1669 - protein, 205 aa, Homo Sapiens
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 1670 - protein, 43 aa, Homo Sapiens
  misc_feature (1)..(1): Xaa can be any naturally occurring amino acid
XFGLSLVYFLSSTFKQSVQHENTYRDPIAKYCYGESPPELFPA

SEQ ID NO: 1671 - protein, 53 aa, Homo Sapiens
MPAGVPMSTYLKMFAASLLAMCAGAEVVHRYYRPDLMRNRLRRVKLISQSHIA

SEQ ID NO: 1672 - protein, 53 aa, Homo Sapiens; identical to SEQ ID NO: 1671

SEQ ID NO: 1673 - protein, 59 aa, Homo Sapiens
MPAGVPMSTYLKMFAASLLAMCAGAEVVHRYYRPDLQNWITSLSVGELEGLGRVEQRRP

SEQ ID NO: 1674 - protein, 59 aa, Homo Sapiens; identical to SEQ ID NO: 1673

SEQ ID NO: 1675 - protein, 71 aa, Homo Sapiens
MPAGVPMSTYLKMFAASLLAMCAGAEVVHRYYRPDLTIPEIPPKRGELKTELLGLKERKHKPQVSQQEELK

SEQ ID NO: 1676 - protein, 71 aa, Homo Sapiens; identical to SEQ ID NO: 1675

SEQ ID NO: 1677 - protein, 71 aa, Homo Sapiens; identical to SEQ ID NO: 1675

SEQ ID NO: 1678 - protein, 71 aa, Homo Sapiens; identical to SEQ ID NO: 1675

SEQ ID NO: 1679 - protein, 37 aa, Homo Sapiens
MPAGVPMSTYLKMFAASLLAMCAGAEVVHRYYRPDLV

SEQ ID NO: 1680 - protein, 46 aa, Homo Sapiens
MPAGVPMSTYLKMFAASLLAMCAGAEVVHRYYRPDLVSAGGLLFYF

SEQ ID NO: 1681 - protein, 135 aa, Homo Sapiens [sequence omitted]

SEQ ID NO: 1682 - protein, 135 aa, Homo Sapiens
MFQNLQGTFEKEIGKIIPFTIAFKRAEAVEPDGCVQSWRCCLPCDLGQASRFIHTTVCSAIRWRSCKGERNFAERHILPAELEEQSNHAGMGPILPAMPSVDGNHFQHPAGDCHPYGILCLQAHSASVTARQVLQ

SEQ ID NO: 1683 - protein, 107 aa, Homo Sapiens
MLERENESHGSKSCSRARIGTEVACRACLPPHCAMPPIDAFLCLPFSFALVSGKLYQWKEPVISSVHSKVKRTAEVKEEIVEKEMKKLVHSVFNMADYTFPLQVNTW

SEQ ID NO: 1684 - protein, 49 aa, Homo Sapiens
MLRPALPWLYLGLCSLLVGEAEAPSPVDPLERSRPYAVLRGQNLDQTLH

SEQ ID NO: 1685 - protein, 76 aa, Homo Sapiens
MLRPALPWLYLGLCSLLVGEAEAPSPVDPLERSRPYAVLRGQNLESLSPRLECNGAISARCNLRVWGSSDSPASAP

SEQ ID NO: 1686 - protein, 76 aa, Homo Sapiens; identical to SEQ ID NO: 1685

SEQ ID NO: 1687 - protein, 61 aa, Homo Sapiens
MLRPALPWLYLGLCSLLVGEAEAPSPVDPLERSRPYAVLRGQNLETTGERICLQLFAQHLT

SEQ ID NO: 1688 - protein, 72 aa, Homo Sapiens
MLRPALPWLYLGLCSLLVGEAEAPSPVDPLERSRPYAVLRGQNLVLMGTIFSILLVTVILMAFCVYKPIRRR

SEQ ID NO: 1689 - protein, 126 aa, Homo Sapiens
MRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLS

SEQ ID NO: 1690 - protein, 358 aa, Homo Sapiens
MRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 1691 - protein, 9 aa, Homo Sapiens
MSFSATILF

SEQ ID NO: 1692 - protein, 9 aa, Homo Sapiens
MSFSATILF

SEQ ID NO: 1693 - protein, 11 aa, Homo Sapiens
MSFSATILFSP

SEQ ID NO: 1694 - protein, 50 aa, Homo Sapiens
MSFSATILFSPPSGSEARCCCCACKSETNGGNTGSQGGNPPPSTPITVTG

SEQ ID NO: 1695 - protein, 79 aa, Homo Sapiens
MSFSATILFSPPSGSEARCCCCACKSETNGGNTGSQGGNPPPSTPITVTGHGLAVQSSEQLLHVIYQRVDKAVGLAEAA

SEQ ID NO: 1696 - protein, 83 aa, Homo Sapiens
MSFSATILFSPPSGSEARCCCCACKSETNGGNTGSQGGNPPPSTPITVTGHGLAVQSSEQLLHVIYQRVDKAVGLAEAALGLA

SEQ ID NO: 1697 - protein, 106 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVS

SEQ ID NO: 1698 - protein, 136 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFK

SEQ ID NO: 1699 - protein, 199 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNP

SEQ ID NO: 1700 - protein, 209 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEG

SEQ ID NO: 1701 - protein, 498 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPDRLPSAEAQLLPPELYNPNFQEEEDEGGDENAPGSPSFDQPHKTCCPDLNSFIEIKVEKDE

SEQ ID NO: 1702 - protein, 538 aa, Homo Sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 1703 - protein, 538 aa, Homo Sapiens; identical to SEQ ID NO: 1702

SEQ ID NO: 1704 - protein, 538 aa, Homo Sapiens; identical to SEQ ID NO: 1702

SEQ ID NO: 1705 - protein, 402 aa, Homo Sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 1706 - protein, 361 aa, Homo Sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 1707 - protein, 434 aa, Homo Sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENNVTGHPVFYLPLCDSFLPPKAAPVTELYTDGPVMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 1708 - protein, 182 aa, Homo Sapiens
MEALVCAFSELHIREDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 1709 - protein, 191 aa, Homo Sapiens
  misc_feature (1)..(1): Xaa can be any naturally occurring amino acid
XEQGPAAPKSWLLLPTTLALHGSLDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 1710 - protein, 90 aa, Homo Sapiens
MKTLPVLVLSLTLLTVFSETSPILTEKQAKQLLRSRRQDRPSKPGFPDEPMREYMHHLLALEHRAEEQFLEHWLNPHCKPHCDRNRIHPV

SEQ ID NO: 1711 - protein, 275 aa, Homo Sapiens
MDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSS

SEQ ID NO: 1712 - protein, 75 aa, Homo Sapiens
MLPSLQESMDGDEKELESSEEGGSAEERRLEPPSSSHYCLYSYRGSRLAQQRGDSEDGSPSGTNAETPSGDDFRY

SEQ ID NO: 1713 - protein, 396 aa, Homo Sapiens
MLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 1714 - protein, 396 aa, Homo Sapiens [sequence omitted]

SEQ ID NO: 1715 - protein, 38 aa, Homo Sapiens
MNCEARGLESHIKSYLSSWFEDVVCPIQRVVLLFQEKL

SEQ ID NO: 1716 - protein, 88 aa, Homo Sapiens
MNCEARGLESHIKSYLSSWFEDVVCPIQRVVLLFQEKLTFLLHAALSYTPVEVKESDEKTKRDINRFLSVASLQGLIHEGTMTSLCMA

SEQ ID NO: 1717 - protein, 132 aa, Homo Sapiens
MNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGN

SEQ ID NO: 1718 - protein, 48 aa, Homo Sapiens
  misc_feature (1)..(1): Xaa can be any naturally occurring amino acid
XAMTEEQHKSVVIDCSSSQPQFCNAGHTRHKQFEEIYPTGRNESLCFV

SEQ ID NO: 1719 - protein, 97 aa, Homo Sapiens
  misc_feature (1)..(1): Xaa can be any naturally occurring amino acid
XLLFQEKLTFLLHAALSYTPVEVKESDEKTKRDINRFLSVASLQGLIHEGTMTSLCMAMTEEQHKSVVIDCSSSQPQFCNAEILDPPPLLFTLSHPS

SEQ ID NO: 1720 - protein, 189 aa, Homo Sapiens
LIALTSLTAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWF

SEQ ID NO: 1721 - protein, 265 aa, Homo Sapiens
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 1722 - protein, 151 aa, Homo Sapiens
  misc_feature (1)..(1): Xaa can be any naturally occurring amino acid
XQPPPPITYSLCGTKNIKVAKKVVKTHEPASFNLNVTLKSSPDLLTYFCWASSTSGAHVDSARLQMHWELWSRQRGRPQGGDDLPGVLGQPTYHQQPDREGWAGPPAAETMPQAACQLLLPAEPDIGLVLVPGCKQRQCPAQRPHSGAPRW

SEQ ID NO: 1723 - protein, 35 aa, Homo Sapiens
ESMIPITRSLQKALHHLSRLRDLVDDTNGERSPKM

SEQ ID NO: 1724 - protein, 372 aa, Homo Sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 1725 - protein, 533 aa, Homo Sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGRLKNPKLMNRTNNCISESSLSFPKKSSFKDSSEHSLEKNYPRWLTSQKSDLNVSGITSIPDFKYPVWLHNQDLLPDANSQRVYQIFKDDQCSPRHSHQAQGTSRLINKLDCFEYAFEPSNFSNSLSDDKELVNEYKCDFEHSQCQCENPLLPGQSTKPFSGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 1726 - protein, 533 aa, Homo Sapiens; identical to SEQ ID NO: 1725

SEQ ID NO: 1727 - protein, 151 aa, Homo Sapiens
MKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 1728 - protein, 142 aa, Homo Sapiens
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEG

SEQ ID NO: 1729 - protein, 355 aa, Homo Sapiens
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 1730 - protein, 422 aa, Homo Sapiens
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 1731 - protein, 141 aa, Homo Sapiens
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQGLTPSPRLECSSTISAHCNLCLPGHVQSCH

SEQ ID NO: 1732 - protein, 146 aa, Homo Sapiens
MVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKAT

SEQ ID NO: 1733 - protein, 168 aa, Homo Sapiens
  misc_feature (1)..(1): Xaa can be any naturally occurring amino acid
XEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQASA

SEQ ID NO: 1734 - protein, 146 aa, Homo Sapiens
  misc_feature (1)..(1): Xaa can be any naturally occurring amino acid
XGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSDGVSLCCPGWSTVARPWLSATSASRVQAVLLPQPPE

SEQ ID NO: 1735 - protein, 133 aa, Homo Sapiens
  misc_feature (1)..(1): Xaa can be any naturally occurring amino acid
XTDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSPTVRCVLPDPPVPPASQRPPRRRWRRAC

SEQ ID NO: 1736 - protein, 110 aa, Homo Sapiens
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGI

SEQ ID NO: 1737 - protein, 140 aa, Homo Sapiens
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 1738 - protein, 88 aa, Homo Sapiens
MVARVWSLMRFLIKGSVAGGAVYLVYDQELLGPSDKSQAALQKAGEVVPPAMYQFSQYVCQQTGLQIPQLPAPPKIYFPIRDSWNAGI

SEQ ID NO: 1739 - protein, 118 aa, Homo Sapiens
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 1740 - protein, 100 aa, Homo Sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNL

SEQ ID NO: 1741 - protein, 131 aa, Homo Sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPA

SEQ ID NO: 1742 - protein, 363 aa, Homo Sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 1743 - protein, 309 aa, Homo Sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEVSLEILLLCQYLD

SEQ ID NO: 1744 - protein, 363 aa, Homo Sapiens; identical to SEQ ID NO: 1742

SEQ ID NO: 1745 - protein, 823 aa, Homo Sapiens
MWGSPALAWAVWLACVQPTVFPWSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 1746 - protein, 658 aa, Homo Sapiens
  misc_feature (1)..(1): Xaa can be any naturally occurring amino acid
XIMKCPMLRSRLGQESVHCGPMFIQVSRPLPLWRDNRQTPWLLSLRGELVASLEDASLMGLYVDMNATTVTVQSPRQGLLQRWEVSGGQQALPGVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 1747 - protein, 69 aa, Homo Sapiens
  misc_feature (1)..(1): Xaa can be any naturally occurring amino acid
XPSTQTLSLWAPTGVLLPSLVELEYPFQAGRGASLQQELTEPTLALSAESHRPPELQDSVEGLSERPSR

SEQ ID NO: 1748 - protein, 775 aa, Homo Sapiens
  misc_feature (1)..(1): Xaa can be any naturally occurring amino acid
XSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 1749 - protein, 15 aa, Homo Sapiens
MALRHLALLAGLLVG

SEQ ID NO: 1750 - protein, 57 aa, Homo Sapiens
MALRHLALLAGLLVGVASKSMENTAQLPECCVDVVGVNASCPGASLCGPGCYRRWNA

SEQ ID NO: 1751 - protein, 86 aa, Homo Sapiens
MALRHLALLAGLLVGVASKSMENTAQLPECCVDVVGVNASCPGASLCGPGCYRRWNADGSASCVRCGNGTLPAYNGSECRSFAGPG

SEQ ID NO: 1752 - protein, 103 aa, Homo Sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHP

SEQ ID NO: 1753 - protein, 224 aa, Homo Sapiens [sequence omitted]

SEQ ID NO: 1754 - protein, 189 aa, Homo Sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSDVGSAGKEDPPRQGRPPIPAPP

SEQ ID NO: 1755 - protein, 344 aa, Homo Sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 1756 - protein, 198 aa, Homo Sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSVRKPRYVRRERPLDRATDPAAFPGEARISNV

SEQ ID NO: 1757 - protein, 198 aa, Homo Sapiens; identical to SEQ ID NO: 1756

SEQ ID NO: 1758 - protein, 98 aa, Homo Sapiens
MALRHLALLAGLLVGVASKSMENTDTDVPAPEVLTRSTAGVRGACASQRGALRCLLGERLLRNGWVRRGPHGEASWPAMGAPLPAVTAQRAAHRYRGV

SEQ ID NO: 1759 - protein, 64 aa, Homo Sapiens
MALRHLALLAGLLVGVASKSMENTDTDVPAPEVLTRSTAGVRGACASQRGALRCLLGPAARVLC

SEQ ID NO: 1760 - protein, 111 aa, Homo Sapiens
MALRHLALLAGLLVGVASKSMENTDTDVPAPEVLTRSTAGVRGACASQRGALRCLLGPAARVLCGCGGRQRQLPRRKSVWSRLLQALERGRERQLRPLWERNPPSLQRLRV

SEQ ID NO: 1761 - protein, 380 aa, Homo Sapiens
MALRHLALLAGLLVGVASKSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 1762 - protein, 289 aa, Homo Sapiens
MARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 1763 - protein, 327 aa, Homo Sapiens
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 1764 - protein, 197 aa, Homo Sapiens
MEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 1765 - protein, 110 aa, Homo Sapiens
MEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 1766 - protein, 160 aa, Homo Sapiens
MQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGP

SEQ ID NO: 1767 - protein, 131 aa, Homo Sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVGMYFM

SEQ ID NO: 1768 - protein, 131 aa, Homo Sapiens; identical to SEQ ID NO: 1767

SEQ ID NO: 1769 - protein, 121 aa, Homo Sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPVEEGCYDSLDGSLARGNWKIK

SEQ ID NO: 1770 - protein, 341 aa, Homo Sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 1771 - protein, 221 aa, Homo Sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDP

SEQ ID NO: 1772 - protein, 245 aa, Homo Sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 1773 - protein, 245 aa, Homo Sapiens; identical to SEQ ID NO: 1772

SEQ ID NO: 1774 - protein, 153 aa, Homo Sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEP

SEQ ID NO: 1775 - protein, 229 aa, Homo Sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNS

SEQ ID NO: 1776 - protein, 251 aa, Homo Sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 1777 - protein, 253 aa, Homo Sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 1778 - protein, 245 aa, Homo Sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 1779 - protein, 245 aa, Homo Sapiens; identical to SEQ ID NO: 1778

SEQ ID NO: 1780 - protein, 245 aa, Homo Sapiens; identical to SEQ ID NO: 1778

SEQ ID NO: 1781 - protein, 258 aa, Homo Sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 1782 - protein, 287 aa, Homo Sapiens
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 1783 - protein, 255 aa, Homo Sapiens
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 1784 - protein, 213 aa, Homo Sapiens
MVLLLVILIPVLVSSAGTSAHYEMLGTCRMVCDPYGGTKAPSTAATPDRGLMQSLPTFIQGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 1785 - protein, 238 aa, Homo Sapiens
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 1786 - protein, 281 aa, Homo Sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 1787 - protein, 281 aa, Homo Sapiens; identical to SEQ ID NO: 1786

SEQ ID NO: 1788 - protein, 281 aa, Homo Sapiens; identical to SEQ ID NO: 1786

SEQ ID NO: 1789 - protein, 281 aa, Homo Sapiens; identical to SEQ ID NO: 1786

SEQ ID NO: 1790 - protein, 281 aa, Homo Sapiens; identical to SEQ ID NO: 1786

SEQ ID NO: 1791 - protein, 281 aa, Homo Sapiens; identical to SEQ ID NO: 1786

SEQ ID NO: 1792 - protein, 281 aa, Homo Sapiens; identical to SEQ ID NO: 1786

SEQ ID NO: 1793 - protein, 281 aa, Homo Sapiens; identical to SEQ ID NO: 1786

SEQ ID NO: 1794 - protein, 199 aa, Homo Sapiens
MYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 1795 - protein, 199 aa, Homo Sapiens; identical to SEQ ID NO: 1794

SEQ ID NO: 1796 - protein, 302 aa, Homo Sapiens
MRRWAWAAVVVLLGPQLVLLGGVGARREAQRTQQPGQRADPPNATASASSREGLPEAPKPSQASGPEFSDAHMTWLNFVRRPDDGALRKRCGSRDKKPRDLFGPPGPPGAEVTAETLLHEFQELLKEATERRFSGLLDPLLPQGAGLRLVGEAFHCRLQGPRRVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 1797 - protein, 330 aa, Homo Sapiens
MGKLCLGPTLCPAAAAEESRDAEPRRELLCSGRPWTWRAAARVTTMIPWVLLACALPCAADPLLGAFARRDFRKGSPQLVCSLPGPQGPPGPPGAPGPSGMMGRMGFPGKDGQDGHDGDRGDSGEEGPPGRTGNRGKPGPKGKAGAIGRAGPRGPKGVNGTPGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 1798 - protein, 246 aa, Homo Sapiens
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 1799 - protein, 319 aa, Homo Sapiens
MLWRQLIYWQLLALFFLPFCLCQDEYMEVSGRTNKVVARIVQSHQQTGRSGSRREKVRERSHPKTGTVDNNTSTDLKSLRPDELPHPEVDDLAQITTFWGQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 1800 - protein, 100 aa, Homo Sapiens
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDE

SEQ ID NO: 1801 - protein, 329 aa, Homo Sapiens
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 1802 - protein, 60 aa, Homo Sapiens
MRPLLVLLLLGLAAGSPPLDDNKIPSLCPGHPGLPGLPGPRGDPGPRGEAGPAGPTGPAG

SEQ ID NO: 1803 - protein, 243 aa, Homo Sapiens
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 1804 - protein, 243 aa, Homo Sapiens; identical to SEQ ID NO: 1803

SEQ ID NO: 1805 - protein, 112 aa, Homo Sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEK

SEQ ID NO: 1806 - protein, 289 aa, Homo Sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 1807 - protein, 289 aa, Homo Sapiens; identical to SEQ ID NO: 1806

SEQ ID NO: 1808 - protein, 151 aa, Homo Sapiens
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSI

SEQ ID NO: 1809 - protein, 296 aa, Homo Sapiens
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 1810 - protein, 256 aa, Homo Sapiens [sequence omitted]

SEQ ID NO: 1811 - protein, 252 aa, Homo Sapiens
MAAPALLLLALLLPVGAWPGLPRRPCVHCCRPAWPPGPYARVSDRDLWRGDLWRGLPRVRPTIDIEILKGEKGEAGVRGRAGRSGKEGPPGARGLQGRRGQKGQVGPPGAACRRAYAAFSVGRREGLHSSDHFQAVPFDTELVNLDGAFDLAAGRFLCTVPGVYFLSLNVHTWNYKETYLHIMLNRRPAAVLYAQPSERSVMQAQSLMLLLAAGDAVWVRMFQRDRDNAIYGEHGDLYITFSGHLVKPAAEL

SEQ ID NO: 1812 - protein, 333 aa, Homo Sapiens
MRIWWLLLAIEICTGNINSQDTCRQGHPGIPGNPGHNGLPGRDGRDGAKGDKGDAGEPGRPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDMPIKFDKILYNEFNHYDTAAGKFTCHIAGVYYFTYHITVFSRNVQVSLVKNGVKILHTKDAYMSSEDQASGGIVLQLKLGDEVWLQVTGGERFNGLFADEDDDTTFTGFLLFSSP

SEQ ID NO: 1813 - protein, 333 aa, Homo Sapiens; identical to SEQ ID NO: 1812

SEQ ID NO: 1814 - protein, 333 aa, Homo Sapiens
MRIWWLLLAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDTAVGKFTCHIAGVYYFTYHITVFSRNVQVSLVKNGVKILHTRDAYVSSEDQASGSIVLQLKLGDEMWLQVTGGERFNGLFADEDDDTTFTGFLLFSSQ

SEQ ID NO: 1815 - protein, 333 aa, Homo Sapiens; identical to SEQ ID NO: 1814

SEQ ID NO: 1816 - protein, 99 aa, Homo Sapiens
MRIWWLLLAIEICTGNINSQDTCRQGHPGIPGNPGHNGLPGRDGRDGAKGDKGDAGEPGCPGSPGKDGTSGEKGERGADGKVEAKGIKGMFRCLWSKTE

SEQ ID NO: 1817 - protein, 49 aa, Homo Sapiens
MSQGNKMLLTFHTDFSNEENGTIMFYKGFLAYYQAVDLDECASRSKSGE

SEQ ID NO: 1818 - protein, 72 aa, Homo Sapiens
MSQGNKMLLTFHTDFSNEENGTIMFYKGFLAYYQAVDLDECASRSKSGEEDPQPQCQHLCHNYVGGYFCSCR

SEQ ID NO: 1819 - protein, 94 aa, Homo Sapiens
MSQGNKMLLTFHTDFSNEENGTIMFYKGFLAYYQAVDLDECASRSKSGEEDPQPQCQHLCHNYVGGYFCSCRPGYELQEDRHSCQAECSSELYT

SEQ ID NO: 1820 - protein, 719 aa, Homo Sapiens
MSVRFRVGREENAQWWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 1821 - protein, 705 aa, Homo Sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 1822 - protein, 156 aa, Homo Sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVGEEDPQPQCQHLCHN

SEQ ID NO: 1823 - protein, 144 aa, Homo Sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVGLW

SEQ ID NO: 1824 - protein, 156 aa, Homo Sapiens
MWLLYLLVPALFCRAGGSIPIPQKLFGEVTSPLFPKPYPNNFETTTVITVPTGYRVKLVFQQFDLEPSEGCFYDYVKKEFMSQGNKMLLTFHTDFSNEENGTIMFYKGFLAYYQAVDLDECASRSKSGEEDPQPQCQHLCHNYVGGYFCSCRPGYE

SEQ ID NO: 1825 - protein, 671 aa, Homo Sapiens
MWLLYLLVPALFCRAGGSIPIPQKLFGEVTSPLFPKPYPNNFETTTVITVPTGYRVKLVFQQFDLEPSEGCFYDYVKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 1826 - protein, 83 aa, Homo Sapiens
GLRPGAVPGLCRGLCHNLIRRFGSKPVLWSARLPSGQAPWSEGVCILREEFAADLPHTAFLGEQDCPPPQGLPGPLPNRGCEL

SEQ ID NO: 1827 - protein, 110 aa, Homo Sapiens
MPGPRVWGKYLWRSPHSKGCPGAISHSSVRIQASSVVSKAPLWAGPLVRGSFQPISEASRGSEAINAPGDNPAKVQNHCQEPYYQAAAAGCGSYADPITDQPSVRFSPQL

SEQ ID NO: 1828 - protein, 314 aa, Homo Sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAASTPSLFLCLSSFTPQGHSPVQPQGPGKTDRMGRRFFSVCLSADGQSPPLPRIRRPSVLPEPSWATSPGKPSPVSTAVGAGPCWGTDGSSLLPTPSTPRTVFLSGRTRV

SEQ ID NO: 1829 - protein, 487 aa, Homo Sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 1830 - protein, 192 aa, Homo Sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGALTCATPGTWKDRQDGEEVLQCMPVCGR

SEQ ID NO: 1831 - protein, 187 aa, Homo Sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGECPSWGCREGASVPSHDPGIFKP

SEQ ID NO: 1832 - protein, 66 aa, Homo Sapiens
  misc_feature (1)..(1): Xaa can be any naturally occurring amino acid
XNPAKVQNHCQEPYYQAAAAGALTCATPGTWKDRQDGEEVLQCMPGCGSYADPITDQPSVRFSPQL

SEQ ID NO: 1833 - protein, 85 aa, Homo Sapiens
  misc_feature (1)..(1): Xaa can be any naturally occurring amino acid
XPGLRPGAVPGLCRGLCHNLIRRFGSKPVLWSARLPSGQAPWSEGVCILREEFAADLPHTAFLGEQDCPPPQGLPGPLPNRGCEL

SEQ ID NO: 1834 - protein, 194 aa, Homo Sapiens
  misc_feature (1)..(1): Xaa can be any naturally occurring amino acid
XSFVGSDPSQFCGQQGSPLGRPPGQREFVSSGRSLRLTFRTQPSSENKTAHLHKGFLALYQTVVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLP

SEQ ID NO: 1835 - protein, 157 aa, Homo Sapiens
MKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDG

SEQ ID NO: 1836 - protein, 521 aa, Homo Sapiens
MKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 1837 - protein, 101 aa, Homo Sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQV

SEQ ID NO: 1838 - protein, 103 aa, Homo Sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPY

SEQ ID NO: 1839 - protein, 168 aa, Homo Sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDM

SEQ ID NO: 1840 - protein, 688 aa, Homo Sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 1841 - protein, 688 aa, Homo Sapiens; identical to SEQ ID NO: 1840

SEQ ID NO: 1842 - protein, 688 aa, Homo Sapiens; identical to SEQ ID NO: 1840

SEQ ID NO: 1843 - protein, 682 aa, Homo Sapiens [sequence omitted]

SEQ ID NO: 1844 - protein, 355 aa, Homo Sapiens
  misc_feature (1)..(1): Xaa can be any naturally occurring amino acid
XSKVRRCRKPGPRDRQLTRVDKSPEMWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEK

SEQ ID NO: 1845 - protein, 620 aa, Homo Sapiens
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1846 - protein, 203 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSV

SEQ ID NO: 1847 - protein, 139 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDG

SEQ ID NO: 1848 - protein, 752 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1849 - protein, 328 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRVRNQESACSRGLPVLTISLCLLPLLRTPLTAHLLQEVFSDYTHAM

SEQ ID NO: 1850 - protein, 104 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKREAPCGLCSGCALSSPCLL

SEQ ID NO: 1851 - protein, 136 aa, Homo Sapiens
MGRPGRAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESA

SEQ ID NO: 1852 - protein, 506 aa, Homo Sapiens
MGTRSAIAAPRILCSRGLRSGSARATGSGVERSPSAAIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1853 - protein, 463 aa, Homo Sapiens
MGTRSAIAAPRILCSRGLRSGSARATGSGVERSPSAANPTLMTSLRTWPLPWALPSPTCLGPPIPPRRQRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCK

SEQ ID NO: 1854 - protein, 84 aa, Homo Sapiens
MGTRSAIAAPRILCSRGLRSGSARATGSGVERSPSAANPTLMTSLRTWPLPWALPSPTCLGPPIPPRRQRKAWAVKSKSSALVI

SEQ ID NO: 1855 - protein, 84 aa, Homo Sapiens; identical to SEQ ID NO: 1854

SEQ ID NO: 1856 - protein, 538 aa, Homo Sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1857 - protein, 158 aa, Homo Sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMV

SEQ ID NO: 1858 - protein, 160 aa, Homo Sapiens
  misc_feature (1)..(1): Xaa can be any naturally occurring amino acid
XLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLAPKPQESGDFPLPHQTSMPSGWASWMWTGEN

SEQ ID NO: 1859 - protein, 526 aa, Homo Sapiens
  misc_feature (1)..(1): Xaa can be any naturally occurring amino acid
XMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1860 - protein, 57 aa, Homo Sapiens
MAAVRVLVASRLAAASAFTSLSPGGRTPSQRAALHLSVPRPAARVALDPGAPEPWRG

SEQ ID NO: 1861 - protein, 163 aa, Homo Sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLDSVSLWTSSLWNCERYMSVM

SEQ ID NO: 1862 - protein, 237 aa, Homo Sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 1863 - protein, 217 aa, Homo Sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGCDASTSLPAPAPWWSWNAALCCPGLSCVWCWQGESRTCVGEHQ

SEQ ID NO: 1864 - protein, 268 aa, Homo Sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 1865 - protein, 224 aa, Homo Sapiens
PSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGHSLKDLPGHCPGRPLKWSLRKRCRLRAPEGGPCCSRVTAGVKVSPMVSTSGSRPCQRSVPWMSAQREEPMALSSVTD

SEQ ID NO: 1866 - protein, 184 aa, Homo Sapiens
QPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMASWACWLMPVIPALWEAKARG

SEQ ID NO: 1867 - protein, 191 aa, Homo Sapiens
  misc_feature (1)..(1): Xaa can be any naturally occurring amino acid
XQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMEEREIAAPQPPGLTSGE

SEQ ID NO: 1868 - protein, 190 aa, Homo Sapiens
  misc_feature (1)..(1): Xaa can be any naturally occurring amino acid
XSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGPGDGGDVSMSVSLRSLSLALSLPGGSCSQPSLPPHRHPACPSGPARLLCLEGATKEEDVNVQVLREAGPAASVSVFRPQEEPRPG

SEQ ID NO: 1869 - protein, 266 aa, Homo Sapiens
CRLNQLSSQGEGSVARQRSVEWRGEASRWNSQMTACRHQESGRTYRRQPCTELGTCNNNSTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSALKSYSIENVTSIANNFPDFSYFRTFPMPSNKSYVVTFIY

SEQ ID NO: 1870 - protein, 219 aa, Homo Sapiens
MAPPSRHCLLLISTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSALKSYSIENVTSIANNFPDFSYFRTFPMPSNKSYVVTFIY

SEQ ID NO: 1871 - protein, 219 aa, Homo Sapiens; identical to SEQ ID NO: 1870

SEQ ID NO: 1872 - protein, 219 aa, Homo Sapiens; identical to SEQ ID NO: 1870

SEQ ID NO: 1873 - protein, 148 aa, Homo Sapiens
MFIKVMFGAGCSVLVNTSCRLVNLTAHLRQKAGLPPDATIALLAEDGNLVSLEEDLKEGASRAQTMGNSLLKERAIYVLVRIIKGEDMASTRYESLLENLDDHYPELAEELRRLSGLSSVGHNWRKRMGTRRGRHEQSPTSRPRKGPD

SEQ ID NO: 1874 - protein, 157 aa, Homo Sapiens
MFIKVMFGAGCSVLVNTSCRLVNLTAHLRQKAGLPPDATIALLAEDGNLVSLEEDLKEGASRAQTMGNSLLKERAIYVLVRIISKRERTWPPPAMSPYWRTWMTITQSWQRNCAGCQASPLWATTGGSVWALGEAAMSKAPLQGPERALIKGMDCTL

SEQ ID NO: 1875 - protein, 142 aa, Homo Sapiens
MFIKVMFGAGCSVLVNTSCRLVNLTAHLRQKAGLPPDATIALLAEDGNLVSLEEDLKEGASRAQTMGNSLLKERAIYVLVRIISKVAQEGEDMASTRYESLLENLDDHYPELAGANRQQPSRTPLAESGIAEKLHQQEGQGP

SEQ ID NO: 1876 - protein, 243 aa, Homo Sapiens
MLLSLLGACAVVGPFHGPEWEPVQGLLSQNHSCRDPQCCGNLLVLCLFLVWQVRHCWHQVTRTRFSTRNVIKVPLQKRAVPSMRCETVFKLTPEFFSPGKSRGLDSQQCAQRQRWGYRRSLQESWAQNLLSPQHPCPGPPSGVHTHSEPIFCTTSISNTCLLPQNSSWKAWQVPWCLHDGQTRPALDMCQEMEQLLLHSQERLVSLEPVISVRSRPTSMTLTTSLPNLLSAERLQFCPQRAPA

SEQ ID NO: 1877 - protein, 696 aa, Homo Sapiens
MAMARLGSWLGEAQWLALVSLFVAALATVGLYLAQWALARARPQPQRRAVEPGEGPRPGSDALLSWILTLGSWRSQWQAAWVTALNEEAERKGGPPFLSFEEDPRQQALELVVQEVSSVLRSAEEKVVVCHVVGQAIQFLVSETPALGAGCRLYDMRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 1878 - protein, 541 aa, Homo Sapiens
MRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 1879 - protein, 182 aa, Homo Sapiens
  misc_feature (1)..(1): Xaa can be any naturally occurring amino acid
XSTIIISGISKDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 1880 - protein, 148 aa, Homo Sapiens
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 1881 - protein, 112 aa, Homo Sapiens
MLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 1882 - protein, 142 aa, Homo Sapiens
MQQLRVRGSYRSASQFAGWRRVFYQARQGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHG

SEQ ID NO: 1883 - protein, 117 aa, Homo Sapiens
MIIDSSRIPSFTQLHSTMTRAPLLLLCVALVLLGHVNGATVRNEDKWKPLNNPRNRDLFFRRLQAYFKGRGLDLGTFPNPFPTNENPRPLSFQSELTASASADYEEQKNSFHNYLKG

SEQ ID NO: 1884 - protein, 385 aa, Homo Sapiens
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 1885 - protein, 922 aa, Homo Sapiens
MHWLASATQTSASIVSSSLLSAVDVSSSLTMSEYFQNTSLPGTANSRQFSLPVVSNAAFLTGSISNFSRASAPAISSAWLQPSASGTSFQPLMGSAYLYQHSSTTMLSGVTGQSHICTSAASYPGVFEWDSTASTVKKSSSLRDFTVTVIDQNTAVSSMSMTAQYYKTSDTNTMVPLYPSLSASLVQGTLTQIPNQQGHNLSLPCQIGSQVYYYNQGTLGPQLSCLQSYGSVSYTGYRASAHQPEMVMVLKEVQPTNVLPPVSTSGMYYSVSSQPITETSVQVMETSLGMDTSLGLQSPSQTFCLPQTPEFSKSFSSRNTQTLESNPSPELGDISITPVQSPTNLLTLSPAPSQEKNENENLDEIKTNLSKPLDVHQILIGNQDPPLLPVEIPDIHPLLACIDPLGQEEQPGSENANLRNKSLSLEDQGIFENGIESSSDLADITTWVEDTYLPPIFSSLQDLDQPESPSAKKAKDTSAIKVNQVQEKSCVIKGHSDQVRKNKHKASEPIQGAPKAKIQPKNPECLLEREVVVGSATVSNSASVNKAKHSSNKPHKAASSRISKTKSHGQEKTKGNRKNSSKKSEESKQSGKKVKVEEKQTIPNMKRKKNQPELSQKTLKKPRSSLGMHMLESVQVFHALGKKIDMKTGFSSSRTLGSSSNTQNRQPFPALKPWLDIQHEGKGPEKIQVKAQKLDGSAEKECTSPSHSELPPPGKVKLIPLPFLTLDQPQARHVSRRPNPLASRRPAVAYPARPDSTNSAQSNAVNPSRPAPTNTSLTGPATPAQPISAKATQPSSANPTQPTVPQSAASRPSAYKTSSCSSLQREPVSTAVTSLRSLPKPQNQFLIQDFSLQPRPWRKPTVPEPVMSTPITEEQRPEREAMKRKAQQERENAAKYTSLGKVQFFIERERDMEIAEYYGYTI

SEQ ID NO: 1886 - protein, 192 aa, Homo Sapiens
ITHRIHWESASLLRSEETKENEGFTVTAEGKGQGTLSVVTMYHAKAKDQLTCNKFDLKVTIKPAPETGIPSPIFLSSVFLEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNL

SEQ ID NO: 1887 - protein, 1663 aa, Homo Sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 1888 - protein, 103 aa, Homo Sapiens
MVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGST

SEQ ID NO: 1889 - protein, 101 aa, Homo Sapiens
NNEKDMALTAFVLISLQEAKDICEEQVNSLPGSITKAGDFLEANYMNLQRSYTVAIAGYALAQMGRLKGPLLNKFLTTAKDEENQKQCQDLGAFTESMVVF

SEQ ID NO: 1890 - protein, 100 aa, Homo Sapiens
  misc_feature (1)..(1): Xaa can be any naturally occurring amino acid
XFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPK

SEQ ID NO: 1891 - protein, 119 aa, Homo Sapiens
MAGQPAATGSPSADKDGMEPNVVARISQWADDHLRLVRGHGIPLWPKLECSGTIIAHCCCSTHFGRKDPPTSASRVAGTTEHQHWNGHSWNNVTFEKHSTDIKIYKLFGYSSRIYKKKC

SEQ ID NO: 1892 - protein, 71 aa, Homo Sapiens
MAGQPAATGSPSADKDGMEPNVVARISQWADDHLRLVRNISTGMAIAGIMLLLRSIRLKSHVVLCWLSWLE

SEQ ID NO: 1893 - protein, 294 aa, Homo Sapiens
MAGQPAATGSPSADKDGMEPNVVARISQWADDHLRLVRNISTGMAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 1894 - protein, 251 aa, Homo Sapiens
MAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 1895 - protein, 115 aa, Homo Sapiens
  misc_feature (1)..(1): Xaa can be any naturally occurring amino acid
XAGQPAATGSPSADKDGMEPNVVARISQWADDHLRLVRGHGIPLWPKLECSGTIIAHCCCSTHFGRKDPPTSASRVAGTTDQVLHLSPRLECNGVISAHCNLCLPGSSDCPASPS

SEQ ID NO: 1896 - protein, 213 aa, Homo Sapiens
MESLLLLPRFGRISDLTVDLSTPEGSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKK

SEQ ID NO: 1897 - protein, 221 aa, Homo Sapiens
MKSENGTVVGSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 1898 - protein, 192 aa, Homo Sapiens
MVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 1899 - protein, 430 aa, Homo Sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 1900 - protein, 1744 aa, Homo Sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 1901 - protein, 1698 aa, Homo Sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 1902 - protein, 1698 aa, Homo Sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 1903 - protein, 1744 aa, Homo Sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 1904 - protein, 118 aa, Homo Sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCILDTGFHHIG

SEQ ID NO: 1905 - protein, 152 aa, Homo Sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTS

SEQ ID NO: 1906 - protein, 597 aa, Homo Sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 1907 - protein, 181 aa, Homo Sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVD

SEQ ID NO: 1908 - protein, 252 aa, Homo Sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 1909 - protein, 252 aa, Homo Sapiens; identical to SEQ ID NO: 1908

SEQ ID NO: 1910 - protein, 252 aa, Homo Sapiens; identical to SEQ ID NO: 1908

SEQ ID NO: 1911 - protein, 251 aa, Homo Sapiens
MFFWCACCLMVAWRVSASDEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 1912 - protein, 95 aa, Homo Sapiens
MAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 1913 - protein, 128 aa, Homo Sapiens
MRVARRTRNVCRCPRAAGPGVPEPRAAPLPLLAMAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 1914 - protein, 1676 aa, Homo Sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 1915 - protein, 72 aa, Homo Sapiens
MAVSVLRLTVVLGLLVLFLTCYADDKPDKPDDKPDDSGKDPKPDFPKFLSLLGTEIIENAVEFILRSMSRST

SEQ ID NO: 1916 - protein, 87 aa, Homo Sapiens
MAVSVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 1917 - protein, 31 aa, Homo Sapiens
MARRSVLYFILLNALINKGQACFCDHYAWTQ

SEQ ID NO: 1918 - protein, 133 aa, Homo Sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLC

SEQ ID NO: 1919 - protein, 934 aa, Homo Sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 1920 - protein, 934 aa, Homo Sapiens; identical to SEQ ID NO: 1919

SEQ ID NO: 1921 - protein, 191 aa, Homo Sapiens
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLVLEILF

SEQ ID NO: 1922 - protein, 325 aa, Homo Sapiens
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPKASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 1923 - protein, 330 aa, Homo Sapiens
MAFLPSWVCVLVGSFSASLAGTSNLSETEPPLWKESPGQLSDYRVENSMYIINPWVYLERMGMYKIILNQTARYFAKFAPDNEQNILWGLPLQYGWQYRTGRLADPTRRTNCGYESGDHMCISVDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 1924 - protein, 843 aa, Homo Sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 1925 - protein, 324 aa, Homo Sapiens
MLWFRGALGVWVWLAAASQPCKNSNAGRRGQHPRRPAGSCVQRLTMRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPESSQSPEESVSASTPAELK

SEQ ID NO: 1926 - protein, 340 aa, Homo Sapiens
MLWFRGALGVWVWLAAASQPCKNSNAGRRGQHPRRPAGSCVQRLTMRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 1927 - protein, 157 aa, Homo Sapiens
MPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPESSQSPEESVSASTPAELK

SEQ ID NO: 1928 - protein, 153 aa, Homo Sapiens
MPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPGPEESVSASTPAELK

SEQ ID NO: 1929 - protein, 295 aa, Homo Sapiens
MRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 1930 - protein, 584 aa, Homo Sapiens
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 1931 - protein, 529 aa, Homo Sapiens
MDTCMTLAFTLSGRFFMLLSQYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 1932 - protein, 591 aa, Homo Sapiens
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 1933 - protein, 539 aa, Homo Sapiens
MRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 1934 - protein, 202 aa, Homo Sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 1935 - protein, 164 aa, Homo Sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYGAQGVVTDRPGVG

SEQ ID NO: 1936 - protein, 559 aa, Homo Sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 1937 - protein, 183 aa, Homo Sapiens
MVRIWTTIMIVLILLLRIGPNKPSLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 1938 - protein, 235 aa, Homo Sapiens
MVRIWTTIMIVLILLLRIGPNKPSLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGGERRARAGRGTRVGGWGPKDPPFQQNPHRSRARRGLGRATAAGALHISTPPPEPLQEQGGGLFHRTRSVYNGLELNTWMKVERLFVEKFHQSFSLDN

SEQ ID NO: 1939 - protein, 202 aa, Homo Sapiens
MVRIWTTIMIVLILLLRIGPNKPSLSGRQAPAQAQTSDLVPSLFPLGLWAPGFCTWSSPDEDKVWRPAWEQGPKGEPDPRGLRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 1940 - protein, 56 aa, Homo Sapiens
HVSLRLDKEHLVNISGGPMTYSHRLEEIRLHFGSEDSQGSEHLLNGQAFSGEEKVC

SEQ ID NO: 1941 - protein, 328 aa, Homo Sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 1942 - protein, 328 aa, Homo Sapiens; identical to SEQ ID NO: 1941

SEQ ID NO: 1943 - protein, 328 aa, Homo Sapiens; identical to SEQ ID NO: 1941

SEQ ID NO: 1944 - protein, 276 aa, Homo Sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPS

SEQ ID NO: 1945 - protein, 42 aa, Homo Sapiens
MEIVWEVLFLLQANFIVCISGDLRRAVRRLWWQSGLEMQVTC

SEQ ID NO: 1946 - protein, 253 aa, Homo Sapiens
MIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 1947 - protein, 328 aa, Homo Sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 1948 - protein, 113 aa, Homo Sapiens
  misc_feature (1)..(1): Xaa can be any naturally occurring amino acid
XDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHAQCFST

SEQ ID NO: 1949 - protein, 187 aa, Homo Sapiens
MRALVLLLSLFLLGGQAQHVSDWTYSEGALDEAHWPQHYPACGGQRQSPINLQRTKISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSL

SEQ ID NO: 1950 - protein, 179 aa, Homo Sapiens
MRALVLLLSLFLLGGQAQHVSDWTYSEGALDEAHWPQHYPACGGQRQSPINLQRTKVRYNPSLKGLNMTGYETQAGEFPMVNNGHTDWQAELFLPSLSSPCGEGAKHKGQRQWLCSPSLDSWWEAIIDGGSLWATLAECGLRAEGPEEGRHMEEKSPASQGACSGSRLPISRGPCTFFL

SEQ ID NO: 1951 - protein, 313 aa, Homo Sapiens
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQGKGHGGHRGRSQNPRVQPTSTRHPLALGSLEA

SEQ ID NO: 1952 - protein, 308 aa, Homo Sapiens
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 1953 - protein, 248 aa, Homo Sapiens
MRALVLLLSLFLLGGQAQHVSDWTYSVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 1954 - protein, 459 aa, Homo Sapiens
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 1955 - protein, 356 aa, Homo Sapiens [sequence omitted]

SEQ ID NO: 1956 - protein, 633 aa, Homo Sapiens
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 1957 - protein, 368 aa, Homo Sapiens
MLSKRGCHARIYADFPIRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 1958 - protein, 9 aa, Homo Sapiens
MRQHDTRNG

SEQ ID NO: 1959 - protein, 306 aa, Homo Sapiens
MRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 1960 - protein, 38 aa, Homo Sapiens
MRQHDTRNGRIVLISGRRSFCSIFSVLPYRDSTQVGQQ

SEQ ID NO: 1961 - protein, 163 aa, Homo Sapiens
  misc_feature (1)..(1): Xaa can be any naturally occurring amino acid
XAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGYVYACMLCSSLGEKISHQCT

SEQ ID NO: 1962 - protein, 306 aa, Homo Sapiens
MCQCVRACVCVCVCACATQRASHSALPGTTISVKDWRLCLLDQFDACARSGLSEPRSLTLRVPSCGKPLPGPGARLGREVTPCLSFAFAWCWLKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 1963 - protein, 370 aa, Homo Sapiens
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 1964 - protein, 167 aa, Homo Sapiens
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 1965 - protein, 227 aa, Homo Sapiens
MGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 1966 - protein, 1091 aa, Homo Sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 1967 - protein, 1103 aa, Homo Sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 1968 - protein, 309 aa, Homo Sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASDSKEISPSPEEIFNAE

SEQ ID NO: 1969 - protein, 280 aa, Homo Sapiens
  misc_feature (1)..(1): Xaa can be any naturally occurring amino acid
XKRLTPRFTLCPNGYYFAIDPNGYVLLHPNLQPKPIGVGIPTINLRKRRPNIQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFN

SEQ ID NO: 1970 - protein, 1073 aa, Homo Sapiens
MAVALGTRRRDRVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1971 - protein, 1090 aa, Homo Sapiens
MAVALGTRRRDRVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPCRQEHIGMPMNTPVPVLLGGNIRVYAL

SEQ ID NO: 1972 - protein, 56 aa, Homo Sapiens
MKLEFLQRKFWAATRQCSTVDGPCTQSCEDSDLDCFVIDNNGFILISKRSRESDYV

SEQ ID NO: 1973 - protein, 56 aa, Homo Sapiens; identical to SEQ ID NO: 1972

SEQ ID NO: 1974 - protein, 282 aa, Homo Sapiens
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1975 - protein, 41 aa, Homo Sapiens
MKLEFLQRKFWAATRQDLDCFVIDNNGFILISKRSRESDYV

SEQ ID NO: 1976 - protein, 267 aa, Homo Sapiens
MKLEFLQRKFWAATRQDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1977 - protein, 1137 aa, Homo Sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1978 - protein, 601 aa, Homo Sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKMPSTNSRPNAPPPWTLAAWSARIRLSEHQQWLHPLPSRPPAPVQRGEETKTQT

SEQ ID NO: 1979 - protein, 1154 aa, Homo Sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPCRQEHIGMPMNTPVPVLLGGNIRVYAL

SEQ ID NO: 1980 - protein, 780 aa, Homo Sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGILVQADRDNREHFKLLVEELMVKGVGVVDQALREAFQILKQFQEAKQGSLCNQAIMLISDGAVEDYEPVFEKYNWPDCKISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSREPGIKLRKKPIQT

SEQ ID NO: 1981 - protein, 1112 aa, Homo Sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1982 - protein, 192 aa, Homo Sapiens
  misc_feature (1)..(1): Xaa can be any naturally occurring amino acid
XELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRESDYV

SEQ ID NO: 1983 - protein, 284 aa, Homo Sapiens
  misc_feature (1)..(1): Xaa can be any naturally occurring amino acid
XGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 1984 - protein, 234 aa, Homo Sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNDTPTAMIRPDPPHPREGQKLLLHCEGRGNPVPQQYLWEKEGSVPPLKMTQ

SEQ ID NO: 1985 - protein, 398 aa, Homo Sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 1986 - protein, 432 aa, Homo Sapiens
MGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 1987 - protein, 128 aa, Homo Sapiens
MGFQKFSPFLALSILVLLQAGSLHAAPFRSALESSPADPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 1988 - protein, 128 aa, Homo Sapiens; identical to SEQ ID NO: 1987

SEQ ID NO: 1989 - protein, 141 aa, Homo Sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHNHCPEESL

SEQ ID NO: 1990 - protein, 141 aa, Homo Sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 1991 - protein, 141 aa, Homo Sapiens; identical to SEQ ID NO: 1990

SEQ ID NO: 1992 - protein, 127 aa, Homo Sapiens
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 1993 - protein, 127 aa, Homo Sapiens; identical to SEQ ID NO: 1992

SEQ ID NO: 1994 - protein, 138 aa, Homo Sapiens
MKKEANLQRGGMGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 1995 - protein, 508 aa, Homo Sapiens
MQFSGEKISGQRDLQKSKMRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 1996 - protein, 162 aa, Homo Sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSCQFSP

SEQ ID NO: 1997 - protein, 290 aa, Homo Sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 1998 - protein, 490 aa, Homo Sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 1999 - protein, 474 aa, Homo Sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 2000 - protein, 474 aa, Homo Sapiens; identical to SEQ ID NO: 1999

SEQ ID NO: 2001 - protein, 274 aa, Homo Sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 2002 - protein, 37 aa, Homo Sapiens
MEKKCTLYFLVLLPFFMILVTAELEESPEDSIQLGVT

SEQ ID NO: 2003 - protein, 78 aa, Homo Sapiens
MEKKCTLYFLVLLPFFMILVTAELEESPEDSIQLGVTRNKIMTAQYECYQKIMQDPIQQAEGVYCNRTWDGWLCWNDV

SEQ ID NO: 2004 - protein, 461 aa, Homo Sapiens [sequence omitted]

SEQ ID NO: 2005 - protein, 461 aa, Homo Sapiens [sequence omitted]

SEQ ID NO: 2006 - protein, 461 aa, Homo Sapiens [sequence omitted]

SEQ ID NO: 2007 - protein, 170 aa, Homo Sapiens
MAPRSAKETFRINPNVAANLSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 2008 - protein, 314 aa, Homo Sapiens
MCPTLNNIVSSLQRNGIFINSLIAALTIGGQQLFSSSTFSCPCQVGKNFYYGSAFLVIPALILLVAGFALRSQMWTITGEYCCSCAPPYRRISPLECKLACLRFFSITGRAVIAPLTWLAVTLLTGTYYECAASEFASVDHYPMFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 2009 - protein, 171 aa, Homo Sapiens
MFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 2010 - protein, 123 aa, Homo Sapiens
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRG

SEQ ID NO: 2011 - protein, 128 aa, Homo Sapiens
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 2012 - protein, 417 aa, Homo Sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 2013 - protein, 247 aa, Homo Sapiens
MLLSVPLLLGLLGLAVAEPAVYFKEQFLDGDGWTSRWIESKHKSDFGKFVLSSGKFYGDEEKDKGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLG

SEQ ID NO: 2014 - protein, 163 aa, Homo Sapiens
  misc_feature (1)..(1): Xaa can be any naturally occurring amino acid
XEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRPERSCRRAGRAK

SEQ ID NO: 2015 - protein, 13 aa, Homo Sapiens
  misc_feature (1)..(1): Xaa can be any naturally occurring amino acid
XEEDVPGQAKDEL

SEQ ID NO: 2016 - protein, 384 aa, Homo Sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 2017 - protein, 142 aa, Homo Sapiens
  misc_feature (1)..(1): Xaa can be any naturally occurring amino acid
XLVQLWAICMLRVALATVYFQEEFLDGEHWRNRWLQSTNDSRFGHFRLSSGKFYGHKEKDKGPDICGFDIKKVHVILHFKNKYHENKKLIRCKVDGFTHLYTLILRPDLSYDVKIDGQSIESGSIEYDWNLTSLKKETSPAE

SEQ ID NO: 2018 - protein, 315 aa, Homo Sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 2019 - protein, 224 aa, Homo Sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGWQAYQGGDR

SEQ ID NO: 2020 - protein, 315 aa, Homo Sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 2021 - protein, 323 aa, Homo Sapiens
MKETDLIIMDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 2022 - protein, 323 aa, Homo Sapiens
MKETDLIIMDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 2023 - protein, 147 aa, Homo Sapiens
  misc_feature (1)..(1): Xaa can be any naturally occurring amino acid
XIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 2024 - protein, 194 aa, Homo Sapiens
ILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAKSLLKKPDGVKSTESSNTTIEDEDVKARKQEIIKVTEQLIEAINNGDFEAYTKICDPGLTAFEPEALGNLVEGMDFHRFYFEN

SEQ ID NO: 2025 - protein, 512 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILEAVLHCHQMGVVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 2026 - protein, 533 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILEAVLHCHQMGVVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 2027 - protein, 478 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 2028 - protein, 499 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 2029 - protein, 492 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 2030 - protein, 478 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 2031 - protein, 478 aa, Homo Sapiens; identical to SEQ ID NO: 2027

SEQ ID NO: 2032 - protein, 510 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 2033 - protein, 489 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 2034 - protein, 498 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 2035 - protein, 182 aa, Homo Sapiens
  misc_feature (1)..(1): Xaa can be any naturally occurring amino acid
XRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 2036 - protein, 173 aa, Homo Sapiens
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 2037 - protein, 32 aa, Homo Sapiens
MEGKWLLCMLLVLGTAIVEAHDGHDDDVIDIE

SEQ ID NO: 2038 - protein, 61 aa, Homo Sapiens
MEGKWLLCMLLVLGTAIVEAHDGHDDDVIDIEDDLDDVIEEVEDSKPDTTAPPSSPKESGR

SEQ ID NO: 2039 - protein, 79 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGT

SEQ ID NO: 2040 - protein, 96 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGKVGGRGNEGVKASR

SEQ ID NO: 2041 - protein, 107 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVE

SEQ ID NO: 2042 - protein, 134 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAK

SEQ ID NO: 2043 - protein, 144 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTK

SEQ ID NO: 2044 - protein, 168 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLL

SEQ ID NO: 2045 - protein, 592 aa, Homo Sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 2046 - protein, 592 aa, Homo Sapiens; identical to SEQ ID NO: 2045

SEQ ID NO: 2047 - protein, 592 aa, Homo Sapiens; identical to SEQ ID NO: 2045

SEQ ID NO: 2048 - protein, 308 aa, Homo Sapiens
MEGKWLLCMLLVLGTAIVEAHDGHDDDVIDIEDDLDDVIEEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRP

SEQ ID NO: 2049 - protein, 131 aa, Homo Sapiens
MKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYT

SEQ ID NO: 2050 - protein, 190 aa, Homo Sapiens
  misc_feature (1)..(1): Xaa can be any naturally occurring amino acid
XGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLKSRGTNHLCFVHKEMGVSFPKTPGARHCSYPKASVLNPDNSFEILVDQSVVNSGNLLNDMTPPVNPS

SEQ ID NO: 2051 - protein, 170 aa, Homo Sapiens
  misc_feature (1)..(1): Xaa can be any naturally occurring amino acid
XLYCGAGQGVRAGRGTGTPAVPGRLEVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLH

SEQ ID NO: 2052 - protein, 111 aa, Homo Sapiens
AEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 2053 - protein, 92 aa, Homo Sapiens
ALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 2054 - protein, 176 aa, Homo Sapiens
LAFWFDVAFIGSIQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 2055 - protein, 608 aa, Homo Sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 2056 - protein, 585 aa, Homo Sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 2057 - protein, 161 aa, Homo Sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 2058 - protein, 120 aa, Homo Sapiens
MAAAAAAVGPGAGGAGSAVPGGAGPCATVSVFPGARLLTIGDANGEIQRHAEQQALRLEVRAGPDSAGIALYSHFCSFYNILKTCRGHTLERSVFSERTEESSAVQYFQFYGYLSQQQNM

SEQ ID NO: 2059 - protein, 343 aa, Homo Sapiens
  misc_feature (1)..(1): Xaa can be any naturally occurring amino acid
XANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHSACLASPAATALCLPG

SEQ ID NO: 2060 - protein, 827 aa, Homo Sapiens
MLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 2061 - protein, 950 aa, Homo Sapiens
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 2062 - protein, 924 aa, Homo Sapiens
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 2063 - protein, 116 aa, Homo Sapiens
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 2064 - protein, 117 aa, Homo Sapiens
MDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 2065 - protein, 396 aa, Homo Sapiens
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 2066 - protein, 399 aa, Homo Sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 2067 - protein, 1119 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 2068 - protein, 661 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYR

SEQ ID NO: 2069 - protein, 1159 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 2070 - protein, 292 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAPIPHSMRETAAVAVGFVSWPASASRSCALCISIAMALST

SEQ ID NO: 2071 - protein, 136 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKGSR

SEQ ID NO: 2072 - protein, 159 aa, Homo Sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKTESCAVAQTGVQWRDLGSLQPPPPVFKRCSCLGLPSSWNYSPLRTWCAWAT

SEQ ID NO: 2073 - protein, 165 aa, Homo Sapiens
RWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAVGFVSWPASASRSCALCISIAMALST

SEQ ID NO: 2074 - protein, 180 aa, Homo Sapiens
  misc_feature (1)..(1): Xaa can be any naturally occurring amino acid
XRNRGSGSWIRVLASECIKKLCPVYFHSNGSEYIMALTTGKHEGYVHFGTIRASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQ

SEQ ID NO: 2075 - protein, 193 aa, Homo Sapiens
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 2076 - protein, 193 aa, Homo Sapiens; identical to SEQ ID NO: 2075

SEQ ID NO: 2077 - protein, 140 aa, Homo Sapiens
MLGVLELLLLGAAWLAGPARGQNETEPIVLEGKCLVVCDSNPTSDPTGTALGISVRSGSAKVAFSAIRSTNHEPSEMSNRTMIIYFDQVSVPSSRGVQIGLVKEGWMEDRCPVLSKGSAEARGRQSGTDSCPLPFVPVSL

SEQ ID NO: 2078 - protein, 110 aa, Homo Sapiens
MDWDKVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 2079 - protein, 108 aa, Homo Sapiens
MFQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 2080 - protein, 224 aa, Homo Sapiens
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 2081 - protein, 224 aa, Homo Sapiens; identical to SEQ ID NO: 2080

SEQ ID NO: 2082 - protein, 205 aa, Homo Sapiens
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 2083 - protein, 154 aa, Homo Sapiens
MWGLSGQSFGRTLTPTLKMRSTWGCCSRTLFSASADTAKRSGDAGRAPQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 2084 - protein, 201 aa, Homo Sapiens
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 2085 - protein, 46 aa, Homo Sapiens
MVKAGTCCATCKEFYQMKQTVLQLKQKIALLPNNAADLGKYITGDK

SEQ ID NO: 2086 - protein, 406 aa, Homo Sapiens
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 2087 - protein, 336 aa, Homo Sapiens
RKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 2088 - protein, 529 aa, Homo Sapiens
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 2089 - protein, 446 aa, Homo Sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 2090 - protein, 414 aa, Homo Sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERVENNVSRDPSRLYKPTKGWEERTKKIGPTGSGPLLHIPHRAIPTWRQGIQRRV

SEQ ID NO: 2091 - protein, 446 aa, Homo Sapiens; identical to SEQ ID NO: 2089

SEQ ID NO: 2092 - protein, 142 aa, Homo Sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEI

SEQ ID NO: 2093 - protein, 163 aa, Homo Sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQ

SEQ ID NO: 2094 - protein, 168 aa, Homo Sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARF

SEQ ID NO: 2095 - protein, 896 aa, Homo Sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 2096 - protein, 1044 aa, Homo Sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 2097 - protein, 1062 aa, Homo Sapiens
MPTTASCKTISLLKLLYSVSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGELLSAELDPFFFSSKANNSAKDEKIKSKDFLKTQDSGLL

SEQ ID NO: 2098 - protein, 1054 aa, Homo Sapiens
MSVSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 2099 - protein, 952 aa, Homo Sapiens
MVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 2100 - protein, 116 aa, Homo Sapiens
MDLLQFLAFLFVLLLSGMGATGTLRTSLDPSLEIYKKMFEVKRREQLLALKNLAQLNDIHQQYKILDVMLKGLFKFIPSTDPFQKALREEEKRRKKEEKRKEIRKGPRISRSQSEL

SEQ ID NO: 2101 - protein, 229 aa, Homo Sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 2102 - protein, 141 aa, Homo Sapiens
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKGRLRSKKKMKVVPLLRR

SEQ ID NO: 2103 - protein, 529 aa, Homo Sapiens
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 2104 - protein, 540 aa, Homo Sapiens
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGLSYNVSVGFGRGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 2105 - protein, 529 aa, Homo Sapiens
MVVIVVVIIIIIARAATWDSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 2106 - protein, 145 aa, Homo Sapiens
MDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 2107 - protein, 270 aa, Homo Sapiens
MLRQLLLAALCLAGPPAPARACQLPSEWRPLSEGCRAELAETIVYARVLALHPEAPGLYNHLPWQYHAGQGGLFYSAEVEMLCDQAWGSMLEVPAGSRLNLTGLGYFSCHSHTVVQDYSYFFFLRMDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 2108 - protein, 212 aa, Homo Sapiens
MALRSMGQFSVFFFFFFWAQKKIASLSHSGFLHWFLLFEAVSSNGVLLFFSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGY

SEQ ID NO: 2109 - protein, 950 aa, Homo Sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 2110 - protein, 950 aa, Homo Sapiens; identical to SEQ ID NO: 2109

SEQ ID NO: 2111 - protein, 261 aa, Homo Sapiens
  misc_feature (1)..(1): Xaa can be any naturally occurring amino acid
XFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGSSVVEREDVPAHLVKDIRNYFQVSPEYFSMLLVGKDGNVKSWYPSPMWSMVIVY

SEQ ID NO: 2112 - protein, 553 aa, Homo Sapiens
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 2113 - protein, 712 aa, Homo Sapiens
MAGVAAHRAHPPFTAHMKNRGLREELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKGPLPRHPCAGPRAPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 2114 - protein, 1476 aa, Homo Sapiens
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 2115 - protein, 139 aa, Homo Sapiens
MPCAARSRSSWRRSWTNTACWSLCPCPGPRSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 2116 - protein, 122 aa, Homo Sapiens
EDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREEKEVEQLEHLRDELKKDC

SEQ ID NO: 2117 - protein, 266 aa, Homo Sapiens
MPPRGPASELLLLRLLLLGAATAAPLAPRPSKEELTRCLAEVVTEVLTVGQVQRGPCTALLHKELCGTEPHGCASTEEKGLLLGDFKKQEAGKMRSSQEVRDEEEEEVAERTHKSEVQEQAIRMQGHRQLHQEEDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREEKEVEQLEHLRDELKKVTETLGEQLRREG

SEQ ID NO: 2118 - protein, 115 aa, Homo Sapiens
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 2119 - protein, 115 aa, Homo Sapiens; identical to SEQ ID NO: 2118

SEQ ID NO: 2120 - protein, 115 aa, Homo Sapiens; identical to SEQ ID NO: 2118

SEQ ID NO: 2121 - protein, 96 aa, Homo Sapiens
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 2122 - protein, 97 aa, Homo Sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 2123 - protein, 98 aa, Homo Sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 2124 - protein, 63 aa, Homo Sapiens
  misc_feature (1)..(1): Xaa can be any naturally occurring amino acid
XVPSTCCFTFSSKKISLQRLKSYVITTSSFRTKLGKEICADPKEKWVQNYMKHLGRKAHTLKT

SEQ ID NO: 2125 - protein, 109 aa, Homo Sapiens
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 2126 - protein, 65 aa, Homo Sapiens
MKISVAAIPFFLLITIALGTKTESSSRGPYHPSECCFTYTTYKIPRQRIMDYYETNSQCSKPGIV

SEQ ID NO: 2127 - protein, 93 aa, Homo Sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 2128 - protein, 115 aa, Homo Sapiens
MRKAYSPLQVLRGCLLLPSLLHALSLQEQPMVWPLTRGPSSASDALSSGGPYHPSECCFTYTTYKIPRQRIMDYYETNSQCSKPGIVFITKRGHSVCTNPSDKWVQDYIKDMKEN

SEQ ID NO: 2129 - protein, 113 aa, Homo Sapiens
MKVSVAALSCLMLVAVLGSQAQFTNDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 2130 - protein, 61 aa, Homo Sapiens
  misc_feature (1)..(1): Xaa can be any naturally occurring amino acid
XCTSYISQSIPCSLMKSYFETSSECSKPGVIFLTKKGRQVCAKPSGPGVQDCMKKLKPYSI

SEQ ID NO: 2131 - protein, 120 aa, Homo Sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 2132 - protein, 53 aa, Homo Sapiens
MKVSEAALSLLVLILIITSASRSQPSWSAVSRSRLTTTSASRVQVILLPQPPE

SEQ ID NO: 2133 - protein, 95 aa, Homo Sapiens
  misc_feature (1)..(1): Xaa can be any naturally occurring amino acid
XVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 2134 - protein, 94 aa, Homo Sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 2135 - protein, 94 aa, Homo Sapiens; identical to SEQ ID NO: 2134

SEQ ID NO: 2136 - protein, 89 aa, Homo Sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 2137 - protein, 104 aa, Homo Sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKASLALPGPVSSL

SEQ ID NO: 2138 - protein, 98 aa, Homo Sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 2139 - protein, 99 aa, Homo Sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 2140 - protein, 65 aa, Homo Sapiens
MKVSAALLCLLLIAATFIPQGLAQPDAINAPVTCCYNFTNRKISVQRLASYRRITSSKCPKEAVM

SEQ ID NO: 2141 - protein, 25 aa, Homo Sapiens
MCCTKSLLLAALMSVLLLHLCGESE

SEQ ID NO: 2142 - protein, 96 aa, Homo Sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 2143 - protein, 95 aa, Homo Sapiens
MCCTKSLLLAALMSVLLLHLCGESEASNFDCCLGYTDRILHPKFIVGFTRQLANEGCDINAIIFHTKKKLSVCANPKQTWVKYIVRLLSKKVKNM

SEQ ID NO: 2144 - protein, 124 aa, Homo Sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKR

SEQ ID NO: 2145 - protein, 134 aa, Homo Sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 2146 - protein, 93 aa, Homo Sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 2147 - protein, 13 aa, Homo Sapiens
FETNSECSKPGVM

SEQ ID NO: 2148 - protein, 137 aa, Homo Sapiens
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCMRMLKLDTRIKTRKN

SEQ ID NO: 2149 - protein, 120 aa, Homo Sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCMRMLKLDTRIKTRKN

SEQ ID NO: 2150 - protein, 119 aa, Homo Sapiens
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 2151 - protein, 119 aa, Homo Sapiens; identical to SEQ ID NO: 2150

SEQ ID NO: 2152 - protein, 150 aa, Homo Sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGK

SEQ ID NO: 2153 - protein, 150 aa, Homo Sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 2154 - protein, 149 aa, Homo Sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQGPHAVKKLSSGNSKLSSSKFSNPISSSKRNVSLLISANSGL

SEQ ID NO: 2155 - protein, 84 aa, Homo Sapiens
MNLWLLACLVAGFLGAWAPAVHTQGVFEDCCLAYHYPIGWAVLRRAWTYRIQEVSGSCNLPAAIRPSCCKEVEFWKLQVIIVQV

SEQ ID NO: 2156 - protein, 94 aa, Homo Sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 2157 - protein, 94 aa, Homo Sapiens; identical to SEQ ID NO: 2156

SEQ ID NO: 2158 - protein, 112 aa, Homo Sapiens
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 2159 - protein, 80 aa, Homo Sapiens
MCRIQRADGDCDLAAVILHVKRRRICVSPHNHTVKQWMKVQAAKKNGKGNVCHRKKHHGKRNSNRAHQGKHETYGHKTPY

SEQ ID NO: 2160 - protein, 127 aa, Homo Sapiens
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 2161 - protein, 127 aa, Homo Sapiens; identical to SEQ ID NO: 2160

SEQ ID NO: 2162 - protein, 92 aa, Homo Sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 2163 - protein, 93 aa, Homo Sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 2164 - protein, 92 aa, Homo Sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 2165 - protein, 52 aa, Homo Sapiens
MKLCVTVLSLLMLVAAFCSPALSAPNSKPKEASKSVLIPVNPGSRSTCMTWN

SEQ ID NO: 2166 - protein, 47 aa, Homo Sapiens
MKLCVTVLSLLVLVAAFCSLALSAPKASKSALTPVSPGSRSTCMTWN

SEQ ID NO: 2167 - protein, 64 aa, Homo Sapiens
MKLCVTVLSLLVLVAAFCSLALSAPMGSDPPTACCFSYTARKLPRNFVVDYYETSSLCSQPAVV

SEQ ID NO: 2168 - protein, 64 aa, Homo Sapiens; identical to SEQ ID NO: 2167

SEQ ID NO: 2169 - protein, 96 aa, Homo Sapiens
MKLCVTVLSLLVLVAAFCSLALSAPMGSDPPTACCFSYTARKLPRNFVVDYYETSSLCSQPAVVAAPGRIPSTRAAPHGPWSGRGRCLPQARDKAR

SEQ ID NO: 2170 - protein, 86 aa, Homo Sapiens
MKLCVTVLSLLVLVAAFCSLALSAPMGSDPPTACCFSYTARKLPRNFVVDYYETSSLCSQPAVVAAPHGPWSGRGRCLPQARDKAR

SEQ ID NO: 2171 - protein, 103 aa, Homo Sapiens
MKLCVTVLSLLVLVAAFCSLALSAPMGSDPPTACCFSYTARKLPRNFVVDYYETSSLCSQPAVVEWKLQGVCFQCCSGKDPIHQSCPTWTMVRQRKMPTTGKG

SEQ ID NO: 2172 - protein, 92 aa, Homo Sapiens
MKLCVTVLSLLVLVAAFCSLALSAPMGSDPPTACCFSYTARKLPRNFVVDYYETSSLCSQPAVVFQTKRGKQVCADPSESWVQEYVYDLELN

SEQ ID NO: 2173 - protein, 87 aa, Homo Sapiens
MKLCVTVLSLLVLVAAFCSLALSAPMGSDPPTACCFSYTARKLPRNFVVDYYETSSLCSQPAVVGKQVCADPSESWVQEYVYDLELN

SEQ ID NO: 2174 - protein, 103 aa, Homo Sapiens
MKLCVTVLSLLVLVAAFCSLALSAPMGSDPPTACCFSYTARKLPRNFVVDYYETSSLCSQPAVVYRESASSAAPGRIPSTRAAPHGPWSGRGRCLPQARDKAR

SEQ ID NO: 2175 - protein, 68 aa, Homo Sapiens
MKLCVTVLSLLVLVAAFCSLALSAPTKSSEWKLQGVCFQCCSGKDPIHQSCPTWTMVRQRKMPTTGKG

SEQ ID NO: 2176 - protein, 91 aa, Homo Sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 2177 - protein, 91 aa, Homo Sapiens; identical to SEQ ID NO: 2176

SEQ ID NO: 2178 - protein, 150 aa, Homo Sapiens
  misc_feature (1)..(1): Xaa can be any naturally occurring amino acid
XAALAVILIATALCAPASASPYSSDTTPCCFAYIARPLPRAHIKEYFYTSGKCSNPAVVHRSRMPKREGQQVWQDFLYDSRLNKGKLCHPKEPPSVCQPREEMGSGVHQLFGDELGWRVLEPELTQICLFLLALVLAWEASPHYPTPPAP

SEQ ID NO: 2179 - protein, 47 aa, Homo Sapiens
MKASAALLCLLLTAAAFSPQGLAQPASRPNWTRRSVLTPHRSGSRTL

SEQ ID NO: 2180 - protein, 81 aa, Homo Sapiens
MKASAALLCLLLTAAAFSPQGLAQPERPRTHPQWTFLLVVSLQLGLILQLPAATDLSIRKSLSRGWRATEGPPVATVPGKL

SEQ ID NO: 2181 - protein, 99 aa, Homo Sapiens
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 2182 - protein, 99 aa, Homo Sapiens
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 2183 - protein, 68 aa, Homo Sapiens [sequence omitted]

SEQ ID NO: 2184 - protein, 4 aa, Homo Sapiens
MSLC

SEQ ID NO: 2185 - protein, 154 aa, Homo Sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYK

SEQ ID NO: 2186 - protein, 277 aa, Homo Sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 2187 - protein, 277 aa, Homo Sapiens; identical to SEQ ID NO: 2186

SEQ ID NO: 2188 - protein, 277 aa, Homo Sapiens; identical to SEQ ID NO: 2186

SEQ ID NO: 2189 - protein, 277 aa, Homo Sapiens; identical to SEQ ID NO: 2186

SEQ ID NO: 2190 - protein, 277 aa, Homo Sapiens; identical to SEQ ID NO: 2186

SEQ ID NO: 2191 - protein, 277 aa, Homo Sapiens; identical to SEQ ID NO: 2186

SEQ ID NO: 2192 - protein, 102 aa, Homo Sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQYFL

SEQ ID NO: 2193 - protein, 64 aa, Homo Sapiens
  misc_feature (1)..(1): Xaa can be any naturally occurring amino acid
XEFSRSPAICPACNSTLSGKLDIVRTELSPSEEYKAMVLAGLRPEIVLDISSRALAFWTYQYFL

SEQ ID NO: 2194 - protein, 31 aa, Homo Sapiens
  misc_feature (1)..(1): Xaa can be any naturally occurring amino acid
XTLAPERWPSGHIRLVSNSWVQAILPPQPPE

SEQ ID NO: 2195 - protein, 526 aa, Homo Sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 2196 - protein, 428 aa, Homo Sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRQDEVLLRCPGRSRTPGLK

SEQ ID NO: 2197 - protein, 232 aa, Homo Sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWVVHDGKS

SEQ ID NO: 2198 - protein, 172 aa, Homo Sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSDQLHLPKPG

SEQ ID NO: 2199 - protein, 172 aa, Homo Sapiens; identical to SEQ ID NO: 2198

SEQ ID NO: 2200 - protein, 172 aa, Homo Sapiens; identical to SEQ ID NO: 2198

SEQ ID NO: 2201 - protein, 172 aa, Homo Sapiens; identical to SEQ ID NO: 2198

SEQ ID NO: 2202 - protein, 172 aa, Homo Sapiens; identical to SEQ ID NO: 2198

SEQ ID NO: 2203 - protein, 59 aa, Homo Sapiens
  misc_feature (1)..(1): Xaa can be any naturally occurring amino acid
XRKKPNYELLEKEVEKRKVALQEAKLKAKGLNPDGTPALSTLGGFSPASKPCKMYLELK

SEQ ID NO: 2204 - protein, 520 aa, Homo Sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 2205 - protein, 236 aa, Homo Sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEDPLLKWDSWQRL

SEQ ID NO: 2206 - protein, 227 aa, Homo Sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEGIT

SEQ ID NO: 2207 - protein, 226 aa, Homo Sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEGK

SEQ ID NO: 2208 - protein, 180 aa, Homo Sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVRARPRASGPGGHGYRAGVVPAVLLYQVLREALHGACVNGLCPPGFQDRRGPKTHTGRHQCVSPPSTAERQKEARASTTGSRLC

SEQ ID NO: 2209 - protein, 86 aa, Homo Sapiens
MATGQVLFQRFFYTKSFVKHSMEHVSMACVHLASKIEEAPRRIRDVINVFHRLRQLRDKKKPVPLLLDQDYVNLKNQIIKAERRVL

SEQ ID NO: 2210 - protein, 347 aa, Homo Sapiens [sequence omitted]

SEQ ID NO: 2211 - protein, 46 aa, Homo Sapiens
  misc_feature (1)..(1): Xaa can be any naturally occurring amino acid
XEEAPRRIRDVINVFHRLRQLRDKKPCALSLAGSPCLYYWIKIMLI

SEQ ID NO: 2212 - protein, 55 aa, Homo Sapiens
MERASCLLLLLLPLVHVSATTPEPCELDDEDFRCVCNFSEPQPDWSEAFQCVSAV

SEQ ID NO: 2213 - protein, 81 aa, Homo Sapiens
MERASCLLLLLLPLVHVSATTPEPCELDDEDFRCVCNFSEPQPDWSEAFQCVSAVEVEIHAGGLNLEPFLKRVDADADPRQ

SEQ ID NO: 2214 - protein, 213 aa, Homo Sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLM

SEQ ID NO: 2215 - protein, 375 aa, Homo Sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 2216 - protein, 375 aa, Homo Sapiens; identical to SEQ ID NO: 2215

SEQ ID NO: 2217 - protein, 72 aa, Homo Sapiens
MLLEPGRGCCALAILLAIVDIQSGETGNYTVTGLKQRQHLEFSHNEGTLSSGFLQEKVWVMLVTSLVALQAL

SEQ ID NO: 2218 - protein, 125 aa, Homo Sapiens
MLLEPGRGCCALAILLAIVDIQSGETGNYTVTGLKQRQHLEFSHNEGTLSSGFLQEKVWVMLVTSLVALQGMSKRAVSTPSNEGAIIFLPPWLFSRRRRLERMSRGREKCYSSPGYPQESSNQFH

SEQ ID NO: 2219 - protein, 181 aa, Homo Sapiens
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 2220 - protein, 181 aa, Homo Sapiens; identical to SEQ ID NO: 2219

SEQ ID NO: 2221 - protein, 234 aa, Homo Sapiens
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQGMSKRAVSTPSNEGAIIFLPPWLFSRRRRLERMSRGREKCYSSPGYPQESSNQFH

SEQ ID NO: 2222 - protein, 163 aa, Homo Sapiens
MRKGRKVPMYVPGVLRTYPKAKLEETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 2223 - protein, 184 aa, Homo Sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSAKPTVQPSPSTTSKTVTTSGTTNNTVTPTSQPVRKSTFDAASFIGGIVLVLGVQAVIFFLYKFCKSKERNYHTL

SEQ ID NO: 2224 - protein, 157 aa, Homo Sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSEIRCHTRNYIPDLKK

SEQ ID NO: 2225 - protein, 189 aa, Homo Sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLEIRCHTRNYIPDLKK

SEQ ID NO: 2226 - protein, 197 aa, Homo Sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 2227 - protein, 178 aa, Homo Sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTGTTNNTVTPTSQPVRKSTFDAASFIGGIVLVLGVQAVIFFLYKFCKSKERNYHTL

SEQ ID NO: 2228 - protein, 437 aa, Homo Sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPVCNLLNGTQEIGPVGMTENCDMKDFLTCHRGTTIMTHGNLAQEPTDWTTSNTEMCEVGQVCQETLLLLDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 2229 - protein, 145 aa, Homo Sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPMMGAAEGPFGKAEQVDS

SEQ ID NO: 2230 - protein, 139 aa, Homo Sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPAGACGRVGRRGRGC

SEQ ID NO: 2231 - protein, 286 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 2232 - protein, 298 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 2233 - protein, 231 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 2234 - protein, 290 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 2235 - protein, 388 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 2236 - protein, 376 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 2237 - protein, 321 aa, Homo Sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 2238 - protein, 289 aa, Homo Sapiens
MLLLFLLFEGLCCPGENTADPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 2239 - protein, 101 aa, Homo Sapiens
MLLLFLLFEGLCCPGENTAVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 2240 - protein, 187 aa, Homo Sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 2241 - protein, 199 aa, Homo Sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 2242 - protein, 132 aa, Homo Sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 2243 - protein, 144 aa, Homo Sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 2244 - protein, 60 aa, Homo Sapiens
  misc_feature (1)..(1): Xaa can be any naturally occurring amino acid
XVSGFYPKPVWVMWMRGEQEQRGTQRGDVLPNADETWWIFHLSHPDLFDCDSYPGHIGCS

SEQ ID NO: 2245 - protein, 351 aa, Homo Sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 2246 - protein, 133 aa, Homo Sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQGKCSFP

SEQ ID NO: 2247 - protein, 294 aa, Homo Sapiens
MERLTLTRTIGGPLLTATLLGKTTINDYQVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 2248 - protein, 150 aa, Homo Sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYAHSIPSLQIL

SEQ ID NO: 2249 - protein, 269 aa, Homo Sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 2250 - protein, 202 aa, Homo Sapiens
MKVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNK

SEQ ID NO: 2251 - protein, 62 aa, Homo Sapiens
MPFSHLSTYSLVWVMAAVVLCTAQVQVVTQDEREQLYTPASLKCSLQNAQEALIVTWQKKKA

SEQ ID NO: 2252 - protein, 76 aa, Homo Sapiens
MVTFSENHGVVIQPAYKDKINITQLGLQNSTITFWNITLEDEGCYMCLFNTFGFGKISGTACLTVYAHSIPSLQIL

SEQ ID NO: 2253 - protein, 195 aa, Homo Sapiens
MVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 2254 - protein, 165 aa, Homo Sapiens
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 2255 - protein, 325 aa, Homo Sapiens
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 2256 - protein, 188 aa, Homo Sapiens
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 2257 - protein, 348 aa, Homo Sapiens
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 2258 - protein, 212 aa, Homo Sapiens
MLCPWRTANLGLLLILTIFLVAVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPG

SEQ ID NO: 2259 - protein, 153 aa, Homo Sapiens
HIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKRESPRHACGKGKVCVTFSPAPQGACTQGRGKPAQTAASSSPGHAALSALVFREKDLL

SEQ ID NO: 2260 - protein, 159 aa, Homo Sapiens [sequence omitted]

SEQ ID NO: 2261 - protein, 138 aa, Homo Sapiens
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERP

SEQ ID NO: 2262 - protein, 145 aa, Homo Sapiens
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQL

SEQ ID NO: 2263 - protein, 191 aa, Homo Sapiens
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSVAPRGGSNEAGCCHLDLLDHQVCLHPERAQVLPTVESPWEDCDLPASGCRWEVPLQ

SEQ ID NO: 2264 - protein, 106 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSI

SEQ ID NO: 2265 - protein, 133 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIH

SEQ ID NO: 2266 - protein, 164 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSDPPKKVTTVIQNPMPIREGDTVTLSCN

SEQ ID NO: 2267 - protein, 226 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADG

SEQ ID NO: 2268 - protein, 670 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 2269 - protein, 670 aa, Homo Sapiens; identical to SEQ ID NO: 2268

SEQ ID NO: 2270 - protein, 847 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 2271 - protein, 759 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 2272 - protein, 751 aa, Homo Sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKRCRVLRDAETSPGLR

SEQ ID NO: 2273 - protein, 38 aa, Homo Sapiens
MHLLGPWLLLLVNGFLSTLKPSTPGRGPASGSPAPTEP

SEQ ID NO: 2274 - protein, 675 aa, Homo Sapiens
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 2275 - protein, 145 aa, Homo Sapiens
NPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQ

SEQ ID NO: 2276 - protein, 148 aa, Homo Sapiens
VLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSVESPWEDCDLPASGCRWEVPLQ

SEQ ID NO: 2277 - protein, 37 aa, Homo Sapiens
IVIPDVTVSDSGLYRCYLQASAGENETFVMRLTVAEG

SEQ ID NO: 2278 - protein, 127 aa, Homo Sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQS

SEQ ID NO: 2279 - protein, 132 aa, Homo Sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEA

SEQ ID NO: 2280 - protein, 336 aa, Homo Sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 2281 - protein, 276 aa, Homo Sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLN

SEQ ID NO: 2282 - protein, 336 aa, Homo Sapiens; identical to SEQ ID NO: 2280

SEQ ID NO: 2283 - protein, 181 aa, Homo Sapiens
MTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 2284 - protein, 181 aa, Homo Sapiens; identical to SEQ ID NO: 2283

SEQ ID NO: 2285 - protein, 80 aa, Homo Sapiens
MGRAMVARLGLGLLLLALLLPTQIYSSETTTGTSSNSSQSTSNSGLAPNPTNATTKAAGGALQSTASLFVVSLSLLHLYS

SEQ ID NO: 2286 - protein, 80 aa, Homo Sapiens; identical to SEQ ID NO: 2285

SEQ ID NO: 2287 - protein, 80 aa, Homo Sapiens; identical to SEQ ID NO: 2285

SEQ ID NO: 2288 - protein, 37 aa, Homo Sapiens
MGRAMVARLGLGLLLLALLLPTQKMLRIPNLIDLKNM

SEQ ID NO: 2289 - protein, 129 aa, Homo Sapiens
MVGRFCPESPPGFVRVAATSAVSLDPPSGEPRPGCGYPGPRSAASRVYGCTAPARETGGWAWETLAGAGAKKIYSSETTTGTSSNSSQSTSNSGLAPNPTNATTKAAGGALQSTASLFVVSLSLLHLYS

SEQ ID NO: 2290 - protein, 88 aa, Homo Sapiens
  misc_feature (1)..(1): Xaa can be any naturally occurring amino acid
XDRSGPGHRLRGAPTSREGFALGGARVPSARIYSSETTTGTSSNSSQSTSNSGLAPNPTNATTKAAGGALQSTASLFVVSLSLLHLYS

SEQ ID NO: 2291 - protein, 122 aa, Homo Sapiens
  misc_feature (1)..(1): Xaa can be any naturally occurring amino acid
XLSSAAGREITLPEGSRRPPPTRSHWNSQPLSGPRGAFCSLSGNALAPGQAATPPQRRRGLFFWGIYSSETTTGTSSNSSQSTSNSGLAPNPTNATTKAAGGALQSTASLFVVSLSLLHLYS

SEQ ID NO: 2292 - protein, 38 aa, Homo Sapiens
MLRRRGSPGMGVHVGAALGALWFCLTADRYQTAGAQLC

SEQ ID NO: 2293 - protein, 38 aa, Homo Sapiens; identical to SEQ ID NO: 2292

SEQ ID NO: 2294 - protein, 51 aa, Homo Sapiens
MLRRRGSPGMGVHVGAALGALWFCLTGALEVQVPEDPVVALVGTDATLCCS

SEQ ID NO: 2295 - protein, 133 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAA

SEQ ID NO: 2296 - protein, 133 aa, Homo Sapiens; identical to SEQ ID NO: 2295

SEQ ID NO: 2297 - protein, 136 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSL

SEQ ID NO: 2298 - protein, 156 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLR

SEQ ID NO: 2299 - protein, 165 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITC

SEQ ID NO: 2300 - protein, 534 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 2301 - protein, 533 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEGKDTWA

SEQ ID NO: 2302 - protein, 316 aa, Homo Sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 2303 - protein, 316 aa, Homo Sapiens; identical to SEQ ID NO: 2302

SEQ ID NO: 2304 - protein, 146 aa, Homo Sapiens
MSLKAPMSSRKKKLYLQQHCEAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASL

SEQ ID NO: 2305 - protein, 388 aa, Homo Sapiens
MTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 2306 - protein, 199 aa, Homo Sapiens
  misc_feature (1)..(1): Xaa can be any naturally occurring amino acid
XRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITEALWVTVGLSVCLIALLVALAFVCWRKIKQSCEEENAGAEDQDGEGEGSKTALQPLKHSDSKEDDGQEIA

SEQ ID NO: 2307 - protein, 170 aa, Homo Sapiens
  misc_feature (1)..(1): Xaa can be any naturally occurring amino acid
XTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 2308 - protein, 169 aa, Homo Sapiens
MTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 2309 - protein, 103 aa, Homo Sapiens
MWLPWALLLLWVPAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 2310 - protein, 186 aa, Homo Sapiens
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 2311 - protein, 150 aa, Homo Sapiens
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQASPREELHYASVVFDSNTNRIAAQRPREEEPDSDYSVIRKT

SEQ ID NO: 2312 - protein, 299 aa, Homo Sapiens
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 2313 - protein, 148 aa, Homo Sapiens
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKR

SEQ ID NO: 2314 - protein, 201 aa, Homo Sapiens
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 2315 - protein, 290 aa, Homo Sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 2316 - protein, 244 aa, Homo Sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRSEGSQAANYRPAAHQAQAPEAQCPPAPHLHHIAAAFGGRLTLGLEDDEVPAESSRDVPRAGTAAPGGRPLLCRPDPAAGRNLPAKGYHEAFLCPG

SEQ ID NO: 2317 - protein, 305 aa, Homo Sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 2318 - protein, 293 aa, Homo Sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 2319 - protein, 165 aa, Homo Sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRYCSPWRATSAMQT

SEQ ID NO: 2320 - protein, 194 aa, Homo Sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNSSRDVPRAGTAAPGGRPLLCRPDPAAGRNLPAKGYHEAFLCPG

SEQ ID NO: 2321 - protein, 194 aa, Homo Sapiens; identical to SEQ ID NO: 2320

SEQ ID NO: 2322 - protein, 239 aa, Homo Sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKGTAAPGGRPLLCRPDPAAGRNLPAKGYHEAFLCPG

SEQ ID NO: 2323 - protein, 239 aa, Homo Sapiens; identical to SEQ ID NO: 2322

SEQ ID NO: 2324 - protein, 273 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPASPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 2325 - protein, 150 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGNRYLSFPRLGTGAAEGRGRGGGA

SEQ ID NO: 2326 - protein, 332 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLTAEEKEAPSQAPEGDVISMPPLHTSEEELGFSKFVSA

SEQ ID NO: 2327 - protein, 307 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 2328 - protein, 233 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGSSRPPMQLDSTSAEDTSPALSSGSSKPRVSIPMVRILAPVLVLLSLLSAAGLIAFCSHLLLWRKEAQQATETQRNEKFCLSRLNHRTSELDPDEAFEISSLTFLSV

SEQ ID NO: 2329 - protein, 222 aa, Homo Sapiens
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 2330 - protein, 98 aa, Homo Sapiens
MEHSTFLSGLVLATLLSQVCQSCVELDPATVAGIIVTDVIATLLLALGVFCFAGHETGRLSGAADTQALLRNDQVYQPLRDRDDAQYSHLGGNWARNK

SEQ ID NO: 2331 - protein, 171 aa, Homo Sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 2332 - protein, 127 aa, Homo Sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 2333 - protein, 132 aa, Homo Sapiens
  misc_feature (1)..(1): Xaa can be any naturally occurring amino acid
XSRCFSGPCSPYSSSVVWIHFQEVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 2334 - protein, 45 aa, Homo Sapiens
MNRGVPFRHLLLVLQLALLPAATQGKKVVLGKKGDTVELTCTASQ

SEQ ID NO: 2335 - protein, 458 aa, Homo Sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 2336 - protein, 148 aa, Homo Sapiens
MNRGVPFRHLLLVLQLGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLG

SEQ ID NO: 2337 - protein, 203 aa, Homo Sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 2338 - protein, 277 aa, Homo Sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 2339 - protein, 151 aa, Homo Sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIDICQPHFPKDRGLNLLM

SEQ ID NO: 2340 - protein, 159 aa, Homo Sapiens
  misc_feature (1)..(1): Xaa can be any naturally occurring amino acid
XRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIAVRPKTWLCNRQAQTRLMLSVVPRIG

SEQ ID NO: 2341 - protein, 176 aa, Homo Sapiens
DTYCFNASAPPEEDCTSVTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILA

SEQ ID NO: 2342 - protein, 269 aa, Homo Sapiens
EDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLL

SEQ ID NO: 2343 - protein, 193 aa, Homo Sapiens
IYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHT

SEQ ID NO: 2344 - protein, 78 aa, Homo Sapiens
MDKFWWHAAWGLCLVPLSLAQIDLNITCRFAGVFHVEKNGRYSISRTEAADLCKAFNSTLPTMAQMEKALSIGFETCR

SEQ ID NO: 2345 - protein, 493 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2346 - protein, 429 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2347 - protein, 361 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2348 - protein, 340 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2349 - protein, 699 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2350 - protein, 277 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTASAHTSHPMQGRTTPSPEDSSWTDFFNPISHPMGRGHQAGRRMDMDSSHSITLQ

SEQ ID NO: 2351 - protein, 742 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2352 - protein, 206 aa, Homo Sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2353 - protein, 139 aa, Homo Sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 2354 - protein, 80 aa, Homo Sapiens
MDKFWWHAAWGLCLVPLSLAQIDLNITCRFAGVFHVEKNGRYSISRTEAADLCKAFNSTLPTMAQMEKALSIGFETCSST

SEQ ID NO: 2355 - protein, 232 aa, Homo Sapiens
PEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLV

SEQ ID NO: 2356 - protein, 195 aa, Homo Sapiens
RNGTTAYEGNWNPEAHPPLIHHEHHEEEETPHSTSTIQATPSSTTEETATQKEQWFGNRWHEGYRQTPKEDSHSTTGTADMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVT

SEQ ID NO: 2357 - protein, 187 aa, Homo Sapiens [sequence omitted]

SEQ ID NO: 2358 - protein, 287 aa, Homo Sapiens
RYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMK

SEQ ID NO: 2359 - protein, 82 aa, Homo Sapiens
SKHNLWSYKDTPNSRCGQKKKLVINSGNGAVEDRKPSGLNGEASKSQEMVHLVNKESSETPDQFMTADETRNLQNVDMKIGV

SEQ ID NO: 2360 - protein, 294 aa, Homo Sapiens
  misc_feature (1)..(1): Xaa can be any naturally occurring amino acid
XDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRS

SEQ ID NO: 2361 - protein, 243 aa, Homo Sapiens
  misc_feature (1)..(1): Xaa can be any naturally occurring amino acid
XDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRND

SEQ ID NO: 2362 - protein, 195 aa, Homo Sapiens
  misc_feature (1)..(1): Xaa can be any naturally occurring amino acid
XFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATKQSNSQSFSTSHEGLEEDKDHPTTSTLTSSNRNDVTGGRRDPNHSEGSTTLL

SEQ ID NO: 2363 - protein, 240 aa, Homo Sapiens
  misc_feature (1)..(1): Xaa can be any naturally occurring amino acid
XLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGDRNDVTGGRRDPNHSEGSTTLLEGYTSHYPHTKESRTFIPVTSAKTGSFGVTAVTVGDSNSNVNRSLSGDQ

SEQ ID NO: 2364 - protein, 118 aa, Homo Sapiens
  misc_feature (1)..(1): Xaa can be any naturally occurring amino acid
XPDEDSPWITDSTDRIPATSWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHH

SEQ ID NO: 2365 - protein, 230 aa, Homo Sapiens
  misc_feature (1)..(1): Xaa can be any naturally occurring amino acid
XQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATISTTPRAFDHTKQNQDWTQWNPSHSNPEVLLQTTTRMTDVDRNGTTAYEGNWNPEAHPPLIHHEHHEEEET

SEQ ID NO: 2366 - protein, 183 aa, Homo Sapiens
  misc_feature (1)..(1): Xaa can be any naturally occurring amino acid
XRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGDMDSSHSITLQPTANPNTGLVEDLDRTGPLSMTTQQ

SEQ ID NO: 2367 - protein, 191 aa, Homo Sapiens
  misc_feature (1)..(1): Xaa can be any naturally occurring amino acid
XSTTPRAFDHTKQNQDWTQWNPSHSNPEVLLQTTTRMTVQATPSSTTEETATQKEQWFGNRWHEGYRQTPKEDSHSTTGTAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRN

SEQ ID NO: 2368 - protein, 243 aa, Homo Sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 2369 - protein, 252 aa, Homo Sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLGKKDPWELRGAQGNWSCFEQRKAGGPIQPPCTVWW

SEQ ID NO: 2370 - protein, 169 aa, Homo Sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLGESGEPKSKSPLQWPQMDHCRASWEAWGTLGEEERKTSGQV

SEQ ID NO: 2371 - protein, 165 aa, Homo Sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAMRPRTRPRTW

SEQ ID NO: 2372 - protein, 495 aa, Homo Sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 2373 - protein, 317 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 2374 - protein, 440 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 2375 - protein, 381 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 2376 - protein, 444 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRCVPRHPAKFLKFIFCRDRIFLCCPGWFQTPGRKRFFRPPKTLRL

SEQ ID NO: 2377 - protein, 550 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 2378 - protein, 439 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSETVFHRVIQDGLDLLASRSACLGLPKCWDYRREPPHLARAHVFHVDRFAWDASNHGLADLAKEELRRKYTQVYRLFLVS

SEQ ID NO: 2379 - protein, 384 aa, Homo Sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSALQVRPFEVSGSSHISSKKMMCIL

SEQ ID NO: 2380 - protein, 326 aa, Homo Sapiens
  misc_feature (1)..(1): Xaa can be any naturally occurring amino acid
XAALPLLGELPRLLLLVLLCLPAVWESSRVEHTMLQTCMSSLSGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKT

SEQ ID NO: 2381 - protein, 268 aa, Homo Sapiens
  misc_feature (1)..(1): Xaa can be any naturally occurring amino acid
XGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSESYSVTQAGVWWCDLRSLQPLPPEFKQFSCLSLRSSWDYRIITGHLLPGDFSVPSTIVDGIYFPTPLSPFFVG

SEQ ID NO: 2382 - protein, 194 aa, Homo Sapiens
  misc_feature (1)..(1): Xaa can be any naturally occurring amino acid
XREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSESYSVTQAGVWWCDLRSLQPLPPEFKQFSCLSLRSSWDYRIEAADLHSECYSS

SEQ ID NO: 2383 - protein, 61 aa, Homo Sapiens
  misc_feature (1)..(1): Xaa can be any naturally occurring amino acid
XTTEVSPTSQKTTTKTTTPNAQATRSTPVSRTTKHFHETTPNKGSGTTSGTTRLLSAIFSC

SEQ ID NO: 2384 - protein, 119 aa, Homo Sapiens
MGIQGGSVLFGLLLVLAVFCHSGHSLQCYNCPNPTADCKTAVNCSSDFDACLITKAELGYHYVAQAGRRQSSHFSLLKCWDYRCEPSHWPHCPYFNWGYKCITSVGSLSIAISTTSQPA

SEQ ID NO: 2385 - protein, 119 aa, Homo Sapiens; identical to SEQ ID NO: 2384

SEQ ID NO: 2386 - protein, 120 aa, Homo Sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFL

SEQ ID NO: 2387 - protein, 128 aa, Homo Sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 2388 - protein, 128 aa, Homo Sapiens; identical to SEQ ID NO: 2387

SEQ ID NO: 2389 - protein, 128 aa, Homo Sapiens; identical to SEQ ID NO: 2387

SEQ ID NO: 2390 - protein, 128 aa, Homo Sapiens; identical to SEQ ID NO: 2387

SEQ ID NO: 2391 - protein, 128 aa, Homo Sapiens; identical to SEQ ID NO: 2387

SEQ ID NO: 2392 - protein, 128 aa, Homo Sapiens; identical to SEQ ID NO: 2387

SEQ ID NO: 2393 - protein, 128 aa, Homo Sapiens; identical to SEQ ID NO: 2387

SEQ ID NO: 2394 - protein, 128 aa, Homo Sapiens; identical to SEQ ID NO: 2387

SEQ ID NO: 2395 - protein, 347 aa, Homo Sapiens
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 2396 - protein, 38 aa, Homo Sapiens
MWLFFGITGLLTAALSGCTVAKWIQLLGEICCFAGMGF

SEQ ID NO: 2397 - protein, 468 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEGPGPAP

SEQ ID NO: 2398 - protein, 668 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 2399 - protein, 601 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 2400 - protein, 592 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 2401 - protein, 422 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQ

SEQ ID NO: 2402 - protein, 278 aa, Homo Sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSESSVTVKIENKESRELML

SEQ ID NO: 2403 - protein, 186 aa, Homo Sapiens
  misc_feature (1)..(1): Xaa can be any naturally occurring amino acid
XNRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSASRSLHNLSTPEVPASVQTVTIESSVTVKIENKESRELMLLIPSIVLGILLLGSLIFIAFILLRIKGKYALPVMVNHQHLPT

SEQ ID NO: 2404 - protein, 354 aa, Homo Sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 2405 - protein, 181 aa, Homo Sapiens [sequence omitted]

SEQ ID NO: 2406 - protein, 327 aa, Homo Sapiens
MRLAVLFSGALLGLLAESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 2407 - protein, 121 aa, Homo Sapiens
  misc_feature (1)..(1): Xaa can be any naturally occurring amino acid
XKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSKTYLLLPS

SEQ ID NO: 2408 - protein, 35 aa, Homo Sapiens
MAGPPRLLLLPLLLALARGLPGALAAQAGACVGST

SEQ ID NO: 2409 - protein, 240 aa, Homo Sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 2410 - protein, 221 aa, Homo Sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQVSVSPSCHLHPKDCSLS

SEQ ID NO: 2411 - protein, 160 aa, Homo Sapiens
MAGPPRLLLLPLLLALARGLPGALAAQGRTFSVLLARLMVTAQVLPRGAAVSPLHDCPRGSLRQHHLLHQRGPAWDLPEAARATAPRHHLLRGRGGAHYGQTVPGPHRLLRVPGQPDYHHAPPAAVGHWHLHLPGHHGGQCLRLRHPGPGDRGTVPRMAQ

SEQ ID NO: 2412 - protein, 140 aa, Homo Sapiens
MHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 2413 - protein, 121 aa, Homo Sapiens
MHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQVSVSPSCHLHPKDCSLS

SEQ ID NO: 2414 - protein, 188 aa, Homo Sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 2415 - protein, 226 aa, Homo Sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 2416 - protein, 258 aa, Homo Sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRREWPSPGPYSHCPAGDTRFIFEVGIEPVPSMWVSNRLGQRDGHSPLQSGVSGGSGALQEVGGARRLGRARGARALSHTTSLQSRPPGPSWTWGRAPRTESSQPRGSSSCSARWCLGRCCCSGNDGRTRSSGW

SEQ ID NO: 2417 - protein, 256 aa, Homo Sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTSFAPRCRERRRNERLRRESVRPV

SEQ ID NO: 2418 - protein, 288 aa, Homo Sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2419 - protein, 288 aa, Homo Sapiens; identical to SEQ ID NO: 2418

SEQ ID NO: 2420 - protein, 217 aa, Homo Sapiens
MDPQCTMGLSNILFVMAFLLSANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 2421 - protein, 329 aa, Homo Sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 2422 - protein, 167 aa, Homo Sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLL

SEQ ID NO: 2423 - protein, 323 aa, Homo Sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 2424 - protein, 275 aa, Homo Sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 2425 - protein, 247 aa, Homo Sapiens
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 2426 - protein, 277 aa, Homo Sapiens
  misc_feature (1)..(1): Xaa can be any naturally occurring amino acid
XTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 2427 - protein, 198 aa, Homo Sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 2428 - protein, 235 aa, Homo Sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 2429 - protein, 235 aa, Homo Sapiens; identical to SEQ ID NO: 2428

SEQ ID NO: 2430 - protein, 198 aa, Homo Sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPVHTRGLDFACDIYIWAPLAGTCGVLLLSLVITLYCNHRNRRRVCKCPRPVVKSGDKPSLSARYV

SEQ ID NO: 2431 - protein, 198 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGLKGKVYQEPLSPNACMDTTAILQPHRSCLTHGS

SEQ ID NO: 2432 - protein, 210 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 2433 - protein, 221 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 2434 - protein, 210 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLYK

SEQ ID NO: 2435 - protein, 243 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQPQGEGISGTFVPQCLHGYYSNTTTSQKLLNPWILKT

SEQ ID NO: 2436 - protein, 213 aa, Homo Sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQPQGEGISGTFVPQCLHGYYSNTTTSQKLLNPWILKT

SEQ ID NO: 2437 - protein, 185 aa, Homo Sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 2438 - protein, 160 aa, Homo Sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENDG

SEQ ID NO: 2439 - protein, 160 aa, Homo Sapiens; identical to SEQ ID NO: 2438

SEQ ID NO: 2440 - protein, 160 aa, Homo Sapiens; identical to SEQ ID NO: 2438

SEQ ID NO: 2441 - protein, 184 aa, Homo Sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENEQGEVDMESHRNANAEPAVQRTLLEK

SEQ ID NO: 2442 - protein, 177 aa, Homo Sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENGQLAGSLGPCIGIRREADG

SEQ ID NO: 2443 - protein, 169 aa, Homo Sapiens
MARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 2444 - protein, 76 aa, Homo Sapiens
MARGAALALLLFGLLGVLVAAPGFGDLRLQAARGGRPGVACHSHALRPGPKFGIARSLRPGWWGEGKEKLEKNFEP

SEQ ID NO: 2445 - protein, 22 aa, Homo Sapiens
  misc_feature (1)..(1): Xaa can be any naturally occurring amino acid
XQKKKLCFKENERASMCVFLSV

SEQ ID NO: 2446 - protein, 109 aa, Homo Sapiens
MAASTSMVPVAVTAAVAPVLSINSDFSDLREIKKQLLLIAGLTRERGLLHSSKWKMPRIWMPIPWPRPTLTLKSMIGQHISCMAAIARKPIFCICIPDIWPPGKRTSEK

SEQ ID NO: 2447 - protein, 597 aa, Homo Sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 2448 - protein, 151 aa, Homo Sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLVRAILKCHSAFSETSIFRTNGKVKSFK

SEQ ID NO: 2449 - protein, 123 aa, Homo Sapiens
MAASTSMVPVAVTAAVAPVLSINSDFSDLREIKKQLLLIAGLTRERGLLHSSKWSAELAFSLPALPLAELQPPPPITEMPRIWMPIPWPRPTLTLKSMIGQHISCMAAIARKPIFCICIPDIW

SEQ ID NO: 2450 - protein, 134 aa, Homo Sapiens
  misc_feature (1)..(1): Xaa can be any naturally occurring amino acid
XSTSMVPVAVTAAVAPVLSINSDFSDLREIKKQLLLIAGLTRERGLLHSSKWSAELAFSLPALPLAELQPPPPITEMPRIWMPIPWPRPTLTLKSMIGQHISCMAAIARKPIFCICIPDICLEKKRRTMKQLIA

SEQ ID NO: 2451 - protein, 579 aa, Homo Sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 2452 - protein, 539 aa, Homo Sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMRVPQSFQNLKEVTAGPQEG

SEQ ID NO: 2453 - protein, 579 aa, Homo Sapiens; identical to SEQ ID NO: 2451

SEQ ID NO: 2454 - protein, 112 aa, Homo Sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYND

SEQ ID NO: 2455 - protein, 566 aa, Homo Sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 2456 - protein, 566 aa, Homo Sapiens; identical to SEQ ID NO: 2455

SEQ ID NO: 2457 - protein, 598 aa, Homo Sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARSGSGSEPVAAALEKSSRLFAGPMSDRTAPRSPRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 2458 - protein, 520 aa, Homo Sapiens
MFVSDFRKEFYEVVQSQRVLLFVASDVDALCACKILQALFQCDHVQYTLVPVSGWQELETAFLEHKEQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 2459 - protein, 159 aa, Homo Sapiens
MLPHWRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRR

SEQ ID NO: 2460 - protein, 96 aa, Homo Sapiens
  misc_feature (1)..(1): Xaa can be any naturally occurring amino acid
XDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRIIY

SEQ ID NO: 2461 - protein, 836 aa, Homo Sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 2462 - protein, 343 aa, Homo Sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 2463 - protein, 449 aa, Homo Sapiens
MLAEWGACLLLAVALLGPGLQAQAMEGVKCGGVLSAPSGNFSSPNFPRLYPYNTECSWLIVVAEGSSVLLTFHAFDLEYHDTCSFDFLEIYNGASPDKGNLLGRFCGKVPPPPFTSSWHVMSVIFHSDKHVASHGFSAGYQKDVCGGVLTGLSGVLTSPEYPNNYPNSMECHWVIRAAGPAHVKLVFVDFQVEGNEECTYDYVAVLGGPGPTRGHHYCGSTRPPTLVSLGHELQVVFKSDFNIGGRGFKAYYFSGECQEVYMAMRGNFSSPQYPSSYPNNIRCHWTIRLPPGYQVKVFFLDLDLEEPNSLTKTCDFDHLAAFDGASEEAPLLGNWCGHHLPPPVTSSHNQLLLLLHTDRSTTRRGFSVAYIGGQLGCGSGSTEGEGEALQPQSLQSPSSIPPVCPAPPMNGLLQLLLHWLHPCPLSGPLRLDGTAPACFHYCRASFPSF

SEQ ID NO: 2464 - protein, 540 aa, Homo Sapiens
MLAEWGACLLLAVALLGPGLQAQAMEGVKCGGVLSAPSGNFSSPNFPRLYPYNTECSWLIVVAEGSSVLLTFHAFDLEYHDTCSFDFLEIYNGASPDKGNLLGRFCGKVPPPPFTSSWHVMSVIFHSDKHVASHGFSAGYQKDVCGGVLTGLSGVLTSPEYPNNYPNSMECHWVIRAAGPAHVKLVFVDFQVEGNEECTYDYVAVLGGPGPTRGHHYCGSTRPPTLVSLGHELQVVFKSDFNIGGRGFKAYYFSGECQEVYMAMRGNFSSPQYPSSYPNNIRCHWTIRLPPGYQVKVFFLDLDLEEPNSLTKTCDFDHLAAFDGASEEAPLLGNWCGHHLPPPVTSSHNQLLLLLHTDRSTTRRGFSVAYIGVVPMNVSCSRTDFQILISTQALAPLERTKVYLGSRSCAAQEVGGNLRIQARFDTCGTESQRRNNTSVIVSVLYIDFSAAGREDIHEYEVRCEPRRKEASVHLLSGSHWLGPYAATAEHLQEAPPMDEAEALEGPVSMVAQDTSDIVFLGLCILAGILMVIAIVVLMLL

SEQ ID NO: 2465 - protein, 882 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 2466 - protein, 821 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 2467 - protein, 537 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITFSSCYWNRDTSADPV

SEQ ID NO: 2468 - protein, 647 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNLASQSIGITDMSHCTCPAPQLPAIF

SEQ ID NO: 2469 - protein, 903 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVWYLARCRNWHPHSCSYPCPLGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 2470 - protein, 647 aa, Homo Sapiens [sequence omitted]

SEQ ID NO: 2471 - protein, 414 aa, Homo Sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVCMVPGKMQKLASSQLFIPLSPGLGF

SEQ ID NO: 2472 - protein, 155 aa, Homo Sapiens
  misc_feature (1)..(1): Xaa can be any naturally occurring amino acid
XTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTEPL

SEQ ID NO: 2473 - protein, 670 aa, Homo Sapiens
MAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 2474 - protein, 22 aa, Homo Sapiens
MKENYCLQAALVCLGMLCHSHA

SEQ ID NO: 2475 - protein, 34 aa, Homo Sapiens
MKENYCLQAALVCLGMLCHSHAFAPERRGHLRPS

SEQ ID NO: 2476 - protein, 54 aa, Homo Sapiens
MKENYCLQAALVCLGMLCHSHAFAPERRGHLRPSFHGHHEKGKEGQVLQRSKRG

SEQ ID NO: 2477 - protein, 65 aa, Homo Sapiens
MKENYCLQAALVCLGMLCHSHAFAPERRGHLRPSFHGHHEKGKEGQVLQRSKRGWVWNQFFVIEE

SEQ ID NO: 2478 - protein, 70 aa, Homo Sapiens
MKENYCLQAALVCLGMLCHSHAFAPERRGHLRPSFHGHHEKGKEGQVLQRSKRGWVWNQFFVIEEYTGPD

SEQ ID NO: 2479 - protein, 222 aa, Homo Sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALP

SEQ ID NO: 2480 - protein, 796 aa, Homo Sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 2481 - protein, 693 aa, Homo Sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTTLTSL

SEQ ID NO: 2482 - protein, 62 aa, Homo Sapiens
  misc_feature (1)..(1): Xaa can be any naturally occurring amino acid
XMSVSEAAVPGEEVGRVKAKDPDIGENGLVTYNIVDGDGMESFEITTDYETQEGVIKLKKVS

SEQ ID NO: 2483 - protein, 760 aa, Homo Sapiens
MKTPPGASSRTKCSRELRSFCAFSCPRAKQPTCTAWFPQQEHPSENGPQMPGRDPPAASTMQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 2484 - protein, 37 aa, Homo Sapiens
MQPRTPLVLCVLLSQSGGPVCKSQFQALPLAVQWLGV

SEQ ID NO: 2485 - protein, 67 aa, Homo Sapiens
MQPRTPLVLCVLLSQTPVRPTIYLCQNLQFIKNKARDSNSLADHKGKRIQVNRLLPGLLFHDELSGI

SEQ ID NO: 2486 - protein, 52 aa, Homo Sapiens
MQPRTPLVLCVLLSQVLLLTSAEDLDCTPGFQQKVFHINQPAEFIEDQSILN

SEQ ID NO: 2487 - protein, 67 aa, Homo Sapiens
MQPRTPLVLCVLLSQVLLLTSAEDLDCTPGFQQKVFHINQPAEFIEDQSILNCKQCHSKMLLDSSHI

SEQ ID NO: 2488 - protein, 175 aa, Homo Sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKMKIWQVLCLARWLT

SEQ ID NO: 2489 - protein, 190 aa, Homo Sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKRTHNPINSELLLNEGITADLNPCITILAI

SEQ ID NO: 2490 - protein, 713 aa, Homo Sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 2491 - protein, 674 aa, Homo Sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 2492 - protein, 56 aa, Homo Sapiens
MQPRTPLVLCVLLSQVLLLTSAEDLDCTPGFQQKVFHINQPAEFIEDQSILNYVFY

SEQ ID NO: 2493 - protein, 147 aa, Homo Sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLY

SEQ ID NO: 2494 - protein, 832 aa, Homo Sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 2495 - protein, 832 aa, Homo Sapiens; identical to SEQ ID NO: 2494

SEQ ID NO: 2496 - protein, 580 aa, Homo Sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPGIILAVVFIRIKKDKGKDNVESAQASEVKPLRS

SEQ ID NO: 2497 - protein, 90 aa, Homo Sapiens
  misc_feature (1)..(1): Xaa can be any naturally occurring amino acid
XIDINDQIPIFEKSDYGNLTLAEDTNIGSTILTIQATDADEPFTGSSKILYHIIKGDSEGRLGVDTDPHTNTGYVIIKKLFTEGRHKRLA

SEQ ID NO: 2498 - protein, 790 aa, Homo Sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 2499 - protein, 790 aa, Homo Sapiens; identical to SEQ ID NO: 2498

SEQ ID NO: 2500 - protein, 590 aa, Homo Sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEGEHIYTYLFIYVVSALTLYVIGFILIYTQTSCKSAFKVSLMLLCYDL

SEQ ID NO: 2501 - protein, 575 aa, Homo Sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEAAAAPSPSGFVHAREMGVCGPAMQKPSCPRLV

SEQ ID NO: 2502 - protein, 790 aa, Homo Sapiens; identical to SEQ ID NO: 2498

SEQ ID NO: 2503 - protein, 574 aa, Homo Sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEAAAPSPSGFVHAREMGVCGPAMQKPSCPRLV

SEQ ID NO: 2504 - protein, 441 aa, Homo Sapiens
WVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIAAAAPSPSGFVHAREMGVCGPAMQKPSCPRLV

SEQ ID NO: 2505 - protein, 434 aa, Homo Sapiens
GIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEK

SEQ ID NO: 2506 - protein, 65 aa, Homo Sapiens
MNCYLLLRFMLGIPLLWPCLGATENSQTKKVKQPVRSHLRVKRGWVWNQFFVPEEMNTTSHHIGQ

SEQ ID NO: 2507 - protein, 772 aa, Homo Sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 2508 - protein, 490 aa, Homo Sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQGLFF

SEQ ID NO: 2509 - protein, 541 aa, Homo Sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQELVLTFKKNLSSTSPS

SEQ ID NO: 2510 - protein, 445 aa, Homo Sapiens
MDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNALAIIITNLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 2511 - protein, 3354 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 2512 - protein, 1061 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGAAPASAHLCRPPGALPPPLPDGQPD

SEQ ID NO: 2513 - protein, 1380 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQAATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 2514 - protein, 1211 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 2515 - protein, 530 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 2516 - protein, 3354 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETQGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVQVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 2517 - protein, 1381 aa, Homo Sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 2518 - protein, 115 aa, Homo Sapiens
MSLRAGGKTRRWPGPEQAARGGRSGGEQSPRRGEARRRCTHAHGSSVTQLLAQDMDNDPLVFGVSGEEASRFFAVEPDTGVVWLRQPLDRETKSEFTVEFSVSDHQGVITRKVNI

SEQ ID NO: 2519 - protein, 1114 aa, Homo Sapiens
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 2520 - protein, 1079 aa, Homo Sapiens
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKLIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 2521 - protein, 6 aa, Homo Sapiens
PCCTLN

SEQ ID NO: 2522 - protein, 29 aa, Homo Sapiens
TGKGHGADTCTSWKAQRNDRRINMAVTKH

SEQ ID NO: 2523 - protein, 396 aa, Homo Sapiens
VITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLWEKFFCSNSSRFSSAQLVVSSWNQL

SEQ ID NO: 2524 - protein, 1035 aa, Homo Sapiens
  misc_feature (1)..(1): Xaa can be any naturally occurring amino acid
XDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEENGGWLQGRPEGVGEGLHVQNLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQHPPWPLKGASSIIFNPFLIDPNVGALKRGHQDGCQDHAWRALFAPPPSWHPGICSTRREAAAPTGHQADAGSTRETQGREPRGFAPALGQHRCQDSVLAPV

SEQ ID NO: 2525 - protein, 165 aa, Homo Sapiens
  misc_feature (1)..(1): Xaa can be any naturally occurring amino acid
XDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLWEKFFCSNSSRFSSAQLVVSSWNQL

SEQ ID NO: 2526 - protein, 223 aa, Homo Sapiens
MPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 2527 - protein, 17 aa, Homo Sapiens
MQRLMMLLATSGACLGL

SEQ ID NO: 2528 - protein, 76 aa, Homo Sapiens
MQRLMMLLATSGACLGLLAVAAVAAAGANPAQRDTHSLLPTHRRQKRDWIWNQMHIDEEKNTSLPHHVGKIKSSVS

SEQ ID NO: 2529 - protein, 131 aa, Homo Sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENL

SEQ ID NO: 2530 - protein, 784 aa, Homo Sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 2531 - protein, 406 aa, Homo Sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIG

SEQ ID NO: 2532 - protein, 669 aa, Homo Sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 2533 - protein, 110 aa, Homo Sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVTQMSPRTG

SEQ ID NO: 2534 - protein, 745 aa, Homo Sapiens
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAEVRRLRYMKNSNFPGTTKSVRKPKFKPKKPHSSQGLFLHPHCEIALFNLSNVNLYSRVFQGAAQAS

SEQ ID NO: 2535 - protein, 859 aa, Homo Sapiens
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 2536 - protein, 135 aa, Homo Sapiens
  misc_feature (1)..(1): Xaa can be any naturally occurring amino acid
XENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKP

SEQ ID NO: 2537 - protein, 78 aa, Homo Sapiens
  misc_feature (1)..(1): Xaa can be any naturally occurring amino acid
XITHAEPANVFDINSHTGEIWLKNSIRSLDALHNITPGRDCLWSLEVQAKDRGSPSFSTTALLKIDITDAEVRRLRSN

SEQ ID NO: 2538 - protein, 598 aa, Homo Sapiens
  misc_feature (1)..(1): Xaa can be any naturally occurring amino acid
XITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 2539 - protein, 48 aa, Homo Sapiens
  misc_feature (1)..(1): Xaa can be any naturally occurring amino acid
XMDGDRGKPNRILYSLVNDFPRQCRTILWHDSPAPPCGPVQNFRVHLP

SEQ ID NO: 2540 - protein, 788 aa, Homo Sapiens
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLHFDGRAQDSRTGRDYLFNTHTGARRWL

SEQ ID NO: 2541 - protein, 184 aa, Homo Sapiens
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQVSPEHGTVGDRMGVGGWRE

SEQ ID NO: 2542 - protein, 199 aa, Homo Sapiens
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPGEARGSRQGGGRHGLSRSSLTSTLASWGNDSGARDSHTWGSAVHSAPPRPRTPRSAGKPRTWDGG

SEQ ID NO: 2543 - protein, 134 aa, Homo Sapiens
QELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVGPAAASTQQTSPGFAAKQHPGN

SEQ ID NO: 2544 - protein, 151 aa, Homo Sapiens
  misc_feature (1)..(1): Xaa can be any naturally occurring amino acid
XSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLQHFDGRAQDSRTGRDYLFNTHTGARRWL

SEQ ID NO: 2545 - protein, 190 aa, Homo Sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLDTKVNSTVIPETQLQAEDRDKDDILFYTLQEMTAGASDYFSLVSVNRPALRLDRPLDFYERPNMTFWLLVRPSVAGHSGGECGTQP

SEQ ID NO: 2546 - protein, 166 aa, Homo Sapiens [sequence omitted]

SEQ ID NO: 2547 - protein, 651 aa, Homo Sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 2548 - protein, 845 aa, Homo Sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 2549 - protein, 845 aa, Homo Sapiens; identical to SEQ ID NO: 2548

SEQ ID NO: 2550 - protein, 106 aa, Homo Sapiens
MGSWALLWPPLLFTGLLVRPPGTMAQAQYCSVNKDIFEVEENTNVTEPLVDIHVPEGQEVTLGALSTPFAFRIQGNQLFLNVTPDYEKAGPFRDEAAWAHTLSTDH

SEQ ID NO: 2551 - protein, 15 aa, Homo Sapiens
MTAGASDYFSLVSVN

SEQ ID NO: 2552 - protein, 116 aa, Homo Sapiens
MEPAAGSSMEPSADWLATAAARGRVEEVRALLEAGALPNAPNSYGRRPIQVGRGSAAGAGDGGRLWRTKFAGELESGSASILRKKGRLPGEFSEGVCNHRPPPGDALGAWEAKEEE

SEQ ID NO: 2553 - protein, 138 aa, Homo Sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARHPRLKEPERL

SEQ ID NO: 2554 - protein, 156 aa, Homo Sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 2555 - protein, 167 aa, Homo Sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSEMIGNHLWVCRSRHA

SEQ ID NO: 2556 - protein, 105 aa, Homo Sapiens
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 2557 - protein, 105 aa, Homo Sapiens; identical to SEQ ID NO: 2556

SEQ ID NO: 2558 - protein, 105 aa, Homo Sapiens; identical to SEQ ID NO: 2556

SEQ ID NO: 2559 - protein, 104 aa, Homo Sapiens
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSGED

SEQ ID NO: 2560 - protein, 121 aa, Homo Sapiens
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSVTASIQVPGGEEGDFGSSYS

SEQ ID NO: 2561 - protein, 132 aa, Homo Sapiens
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 2562 - protein, 132 aa, Homo Sapiens; identical to SEQ ID NO: 2561

SEQ ID NO: 2563 - protein, 85 aa, Homo Sapiens
MSVHMPAMKICEKLKKLDSQICELKYEKTLDLASVDLRKMRVAELKQILHSWGEECRACAEKTDYVNLIQELAPKYAATHPKTEL

SEQ ID NO: 2564 - protein, 187 aa, Homo Sapiens
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 2565 - protein, 111 aa, Homo Sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPA

SEQ ID NO: 2566 - protein, 143 aa, Homo Sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRV

SEQ ID NO: 2567 - protein, 165 aa, Homo Sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHST

SEQ ID NO: 2568 - protein, 1264 aa, Homo Sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 2569 - protein, 1287 aa, Homo Sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGQEGMINLRIPDHLQLAKSCVWEGDSCAHSETEINIVSWNALILPPVPEGCAEKTMWSPPGIPLDSPTEVLQQPRET

SEQ ID NO: 2570 - protein, 641 aa, Homo Sapiens
MLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 2571 - protein, 650 aa, Homo Sapiens
  misc_feature (1)..(1): Xaa can be any naturally occurring amino acid
XDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTS

SEQ ID NO: 2572 - protein, 243 aa, Homo Sapiens
  misc_feature (1)..(1): Xaa can be any naturally occurring amino acid
XNYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENGQEIYVGNV

SEQ ID NO: 2573 - protein, 529 aa, Homo Sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGNSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLNSP

SEQ ID NO: 2574 - protein, 425 aa, Homo Sapiens
MALTGYSWLLLSATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 2575 - protein, 425 aa, Homo Sapiens; identical to SEQ ID NO: 2574

SEQ ID NO: 2576 - protein, 384 aa, Homo Sapiens
MDLSRPRWSLWRRVFLMASLLACGICQASGQIFITQTLGIKGYRTVVALDKVPEDVQEYSWYWGANDSAGNMIISHKPPSAQQPGPMYTGRERVNREGSLLIRPTALNDTGNYTVRVVAGNETQRATGWLEVLELGSNLGISVNASSLVENMDSVAADCLTNVTNITWYVNDVPTSSSDRMTISPDGKTLVILRVSRYDRTIQCMIESFPEIFQRSERISLTVAYGPDYVLLRSNPDDFNGIVTAEIGSQVEMECICYSFLDLKYHWIHNGSLLNFSDAKMNLSSLAWEQMGRYRCTVENPVTQLIMYMDVRIQAPHEDLTCCPQRFLHLRIHGDVPHHADSAGWRLHLWSPDPCSDQPLLNQDKSGSMSVHPRPEDKTRRASR

SEQ ID NO: 2577 - protein, 55 aa, Homo Sapiens
MEIPMGTQGCFSKSLLLSASILVLWMLQGSQAALYIQKIPEQPQKNQDLLLSVQG

SEQ ID NO: 2578 - protein, 56 aa, Homo Sapiens
MEIPMGTQGCFSKSLLLSASILVLWMLQGSQAALYIQKIPEQPQKNQDLLLSVQGV

SEQ ID NO: 2579 - protein, 56 aa, Homo Sapiens; identical to SEQ ID NO: 2578

SEQ ID NO: 2580 - protein, 56 aa, Homo Sapiens; identical to SEQ ID NO: 2578

SEQ ID NO: 2581 - protein, 56 aa, Homo Sapiens; identical to SEQ ID NO: 2578

SEQ ID NO: 2582 - protein, 299 aa, Homo Sapiens
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQDLLNPDPAPYCQLVPTS

SEQ ID NO: 2583 - protein, 300 aa, Homo Sapiens
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 2584 - protein, 346 aa, Homo Sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 2585 - protein, 702 aa, Homo Sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 2586 - protein, 701 aa, Homo Sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 2587 - protein, 702 aa, Homo Sapiens; identical to SEQ ID NO: 2585

SEQ ID NO: 2588 - protein, 702 aa, Homo Sapiens; identical to SEQ ID NO: 2585

SEQ ID NO: 2589 - protein, 524 aa, Homo Sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 2590 - protein, 194 aa, Homo Sapiens
  misc_feature (1)..(1): Xaa can be any naturally occurring amino acid
XIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLSEPPKPFITSNNSNPVEDEDAVALTCEPEIQNTTYLWWVNNQSLPVSPRLQLSNDNRTL

SEQ ID NO: 2591 - protein, 141 aa, Homo Sapiens
  misc_feature (1)..(1): Xaa can be any naturally occurring amino acid
XKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEAQNT

SEQ ID NO: 2592 - protein, 265 aa, Homo Sapiens
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGIYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 2593 - protein, 265 aa, Homo Sapiens; identical to SEQ ID NO: 2592

SEQ ID NO: 2594 - protein, 172 aa, Homo Sapiens
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGIYTLHVIKENLVNEEVTRQFYVFYESVQASSPDLSAGTAVSIMIGVLAGMALI

SEQ ID NO: 2595 - protein, 349 aa, Homo Sapiens
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 2596 - protein, 51 aa, Homo Sapiens
MGPISAPSCRWRIPWQGLLLTDALVQGSSPGLSARATVSIMIGVLARVALI

SEQ ID NO: 2597 - protein, 756 aa, Homo Sapiens
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 2598 - protein, 269 aa, Homo Sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 2599 - protein, 126 aa, Homo Sapiens [sequence omitted]

SEQ ID NO: 2600 - protein, 269 aa, Homo Sapiens
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 2601 - protein, 121 aa, Homo Sapiens
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACG

SEQ ID NO: 2602 - protein, 270 aa, Homo Sapiens
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSAFGCNFIWKPTVFTRVSAFIDWIEETIASH

SEQ ID NO: 2603 - protein, 75 aa, Homo Sapiens
WWGSTVKKTMVCAGGYIRSGCNGDSGGPLNCPTEDGGWQVHGVTSFVSAFGCNFIWKPTVFTRVSAFIDWIEEGG

SEQ ID NO: 2604 - protein, 270 aa, Homo Sapiens
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 2605 - protein, 164 aa, Homo Sapiens
MRSCYVAQAGLKLPGSSDPPASASQSTRITASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAG

SEQ ID NO: 2606 - protein, 180 aa, Homo Sapiens
QVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEEKLQGNKAPESRT

SEQ ID NO: 2607 - protein, 1361 aa, Homo Sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 2608 - protein, 1361 aa, Homo Sapiens; identical to SEQ ID NO: 2607

SEQ ID NO: 2609 - protein, 1361 aa, Homo Sapiens; identical to SEQ ID NO: 2607

SEQ ID NO: 2610 - protein, 76 aa, Homo Sapiens
  misc_feature (1)..(1): Xaa can be any naturally occurring amino acid
XINFNKGDWIRVGLCYPRGTTFSILSDVHNRLLKQTSKTGVFVRTLQMDKVEQSYPGRSHYYWDEDSGKQRTISWR

SEQ ID NO: 2611 - protein, 145 aa, Homo Sapiens
  misc_feature (1)..(1): Xaa can be any naturally occurring amino acid
XRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSG

SEQ ID NO: 2612 - protein, 173 aa, Homo Sapiens
EQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPGPTLLQDLWGVAFLVGNVCGASVPLPEFLSCVQEE

SEQ ID NO: 2613 - protein, 783 aa, Homo Sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 2614 - protein, 428 aa, Homo Sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKASASDSSKTGFRGKQVVAGAVGDSAKESQGQPPGAPPRSF

SEQ ID NO: 2615 - protein, 356 aa, Homo Sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEEVTFPIVKISFSDF

SEQ ID NO: 2616 - protein, 80 aa, Homo Sapiens
MLLGFRRGRRSHFKQGLALSPRLECSGAIIAHCILELLGSSDLPTPASRGAETTGARHYSRLIVQYFCGNRDLAMFLWWS

SEQ ID NO: 2617 - protein, 217 aa, Homo Sapiens
  misc_feature (1)..(1): Xaa can be any naturally occurring amino acid
XAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPGICLLNYIMIEKLVLENIQINFI

SEQ ID NO: 2618 - protein, 267 aa, Homo Sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 2619 - protein, 64 aa, Homo Sapiens
MLQEWLAAVGDDYAAVVWRPEGEPRFYPDEEGPKHWTKERHQFLMELKQEALTFARNWGADYIL

SEQ ID NO: 2620 - protein, 79 aa, Homo Sapiens
MLQEWLAAVGDDYAAVVWRPEGEPRFYPDEEGPKHWTKERHQFLMELKQEALTFARNWGADYILFADTDNILTNNQTLR

SEQ ID NO: 2621 - protein, 109 aa, Homo Sapiens
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQ

SEQ ID NO: 2622 - protein, 218 aa, Homo Sapiens
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALG

SEQ ID NO: 2623 - protein, 517 aa, Homo Sapiens
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 2624 - protein, 517 aa, Homo Sapiens [sequence omitted]

SEQ ID NO: 2625 - protein, 595 aa, Homo Sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 2626 - protein, 155 aa, Homo Sapiens
MTAKQCPGAGHYCPESRGGGCWQGLQILSDLATTLGMATLPSGPVFHREKPLRDGSHSLKVSQQRSRTPRPLYPAWPDSGPCGPQLVSSWADPRIPSLPKDSAEGPLCPFYLHLSTLPQLDVWVSPAPSSLAGAKYREVKQDPCRHVAQHTVGPQ

SEQ ID NO: 2627 - protein, 337 aa, Homo Sapiens
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 2628 - protein, 350 aa, Homo Sapiens
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRF

SEQ ID NO: 2629 - protein, 239 aa, Homo Sapiens
MPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 2630 - protein, 372 aa, Homo Sapiens
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 2631 - protein, 216 aa, Homo Sapiens
  misc_feature (1)..(1): Xaa can be any naturally occurring amino acid
XAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEEAVAQSSVTFFGTGGARCRHLTHPGL

SEQ ID NO: 2632 - protein, 44 aa, Homo Sapiens
ERNFHTVPYMVGINKQEFGWLIPMMLEHPPTCMSFSTVQASHQT

SEQ ID NO: 2633 - protein, 131 aa, Homo Sapiens
KELIPEATEKYLGGTDDTVKKKDLFLDLIADVMFGVPSVIVARNHREGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 2634 - protein, 568 aa, Homo Sapiens
MWLRAFILATLSASAAWAGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 2635 - protein, 567 aa, Homo Sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 2636 - protein, 566 aa, Homo Sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 2637 - protein, 84 aa, Homo Sapiens
  misc_feature (1)..(1): Xaa can be any naturally occurring amino acid
XRQKTEEELLETTLKMKFLSLDLQGDPRESQPLLGTVIDGMLLLKTPEELQAERNFHTVPYMVGINKQEFGWLIPMGTADISVY

SEQ ID NO: 2638 - protein, 210 aa, Homo Sapiens
MEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 2639 - protein, 571 aa, Homo Sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 2640 - protein, 568 aa, Homo Sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 2641 - protein, 379 aa, Homo Sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRILEALSFSMSSSIDPVLLRRSNLPG

SEQ ID NO: 2642 - protein, 40 aa, Homo Sapiens
MERAVRVESGVLVGVVCLLLACPATATGYQDAVWARSCSA

SEQ ID NO: 2643 - protein, 454 aa, Homo Sapiens
GKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRGLSMGKEKALSLQMMKYWANFARTGNPNDGNLPCWPRYNKDEKYLQLDFTTRVGMKLKEKKMAFWMSLYQSQRPEKQRQF

SEQ ID NO: 2644 - protein, 468 aa, Homo Sapiens
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 2645 - protein, 374 aa, Homo Sapiens
MYVSTRERYKWLRFSEDCLYLNVYAPARAPGDPQLPVMVWFPGGAFIVGAASSYEGSDLAAREKVVLVFLQHRLGIFGFLRWRGRTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 2646 - protein, 135 aa, Homo Sapiens
MYVSTRERYKWLRFSEDCLYLNVYAPARAPGDPQLPVMVWFPGGAFIVGAASSYEGSDLAAREKVVLVFLQHRLGIFGFLRWRGRYPLGPQLWPERRGLARTTATRAGTGGCWTRWRLCAGCRRTSQPSGETQEM

SEQ ID NO: 2647 - protein, 463 aa, Homo Sapiens
MYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 2648 - protein, 177 aa, Homo Sapiens
  misc_feature (1)..(1): Xaa can be any naturally occurring amino acid
XALHTKRPQVVTKYGTLQGKQMHVGKTPIQVFLGVPFSRPPLGILRFAPPEPPEPWKGIRDATTYPPGWSLALSPGWSAVARSRLTATSASRVQASLLPQPLSIWGYRCLQESWGQLASMYVSTRERYKWLRFSEDCLYLNVYAPARAPGDPQLPVSDGLVPGRRLHRGRCFFVRGL

SEQ ID NO: 2649 - protein, 604 aa, Homo Sapiens
MAVLVCPASCHGLKEFRIRRGMWRLCLVYYFYPASSTLYVLRIDVLNYTSKDEGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2650 - protein, 355 aa, Homo Sapiens
MEDDLSWRSWSLLCMEILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2651 - protein, 75 aa, Homo Sapiens
MLKVHYPKFGVSEDCLYLNIYAPAHADTGSKLPVLVWFPGGAFKTGSASIFDGSALAAYEDVLVVVVQYRLGIFG

SEQ ID NO: 2652 - protein, 78 aa, Homo Sapiens
MLKVHYPKFGVSEDCLYLNIYAPAHADTGSKLPVLVWFPGGAFKTGSASIFDGSALAAYEDVLVVVVQYRLGIFGFFT

SEQ ID NO: 2653 - protein, 469 aa, Homo Sapiens
MLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2654 - protein, 575 aa, Homo Sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2655 - protein, 525 aa, Homo Sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2656 - protein, 545 aa, Homo Sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2657 - protein, 433 aa, Homo Sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 2658 - protein, 493 aa, Homo Sapiens [sequence omitted]

SEQ ID NO: 2659 - protein, 428 aa, Homo Sapiens
MMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKGHFIYKNVSEDLPLPTFSPTLLGDSRMLYFWFSERVFHSLAKVAFQDGRLMLSLMGDEFKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 2660 - protein, 784 aa, Homo Sapiens
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 2661 - protein, 234 aa, Homo Sapiens
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAPLTAVIYEVQATCWYGAGSRQRSSIQLQAV

SEQ ID NO: 2662 - protein, 1925 aa, Homo Sapiens
MFTLTGCRLVEKTQKVENPSVSFASSFPLIPLLLRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVLQSYSNIEEDCTMCPSWCLTVRARGHSYFAGFEHHIPQYSLDVPKLFPAVSSGEPTYRSLLLVNKDCKLLTFSLAPQRGSDVILRPTSGLVAPGAHQIILICTYPEGSSWKQHTFYLQCNASPQYLKEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLALQLDRTEGSMPPRSQDTICLTACPKQRSQYSWTITYSLLSHRDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWAFLLPSDQRIDVELWAEQAELNSTELHQMRVQDNCLFSISPKAGSLSPGQEQMVELKYSHLFIGTDHLPVLFKVSHGREILLNFIGVTVKPEQKYVHFTSTTHQFIPIPIGDTLPPRQIYELYNGGSVPVTYEVQTDVLSQVQEKNFDHPIFCCLNPKGEIQPGSTARVLWIFSPIEAKTYTVDVPIHILGWNSALIHFQGVGYNPHMMGDTAPFHNISSWDNSSIHSRLVVPGQNVFLSQSHISLGNIPVQSKCSRLLFLNNISKNEEIAFSWQPSPLDFGEVSVSPMIGVVAPEETVPFVVTLRASVHASFYSADLVCKLYSQQLMRQYHKELQEWKDEKVRQEVEFTITDMKVKKRTCCTACEPARKYKTLPPIKNQQSVSRPASWKLQTPKEEVSWPCPQPPSPGMLCLGLTARAHATDYFLANFFSEFPCHFLHRELPKRKAPREESETSEEKSPNKWGPVSKQKKQLLVDILTTIIRGLLEDKNFHEAVDQSLVEQVPYFRQFWNEQSTKFMDQKNSLYLMPILPVPSSSWEDGKGKQPKEDRPEHYPGLGKKEEGEEEKGEEEEEELEEEEEEEEETEEEELGKEEIEEKEEERDEKEEKVSWAGIGPTPQPESQESMQWQWQQQLNVMVKEEQEQDEKEAIRRLPAFANLQEALLENMIQNILVEASRGEVVLTSRPRVIALPPFCVPRSLTPDTLLPTQQAEVLHPVVPLPTDLP

SEQ ID NO: 2663 - protein, 1925 aa, Homo Sapiens; identical to SEQ ID NO: 2662

SEQ ID NO: 2664 - protein, 114 aa, Homo Sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMK

SEQ ID NO: 2665 - protein, 117 aa, Homo Sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRP

SEQ ID NO: 2666 - protein, 730 aa, Homo Sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 2667 - protein, 164 aa, Homo Sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRYQYKGSRTQCHSLEPRKQALFKTKQNKQKKPLTCHIKASECLKYVQYE

SEQ ID NO: 2668 - protein, 271 aa, Homo Sapiens
MTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 2669 - protein, 127 aa, Homo Sapiens
  misc_feature (1)..(1): Xaa can be any naturally occurring amino acid
XKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWYGLKGATGGPGRQVPRG

SEQ ID NO: 2670 - protein, 144 aa, Homo Sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRT

SEQ ID NO: 2671 - protein, 764 aa, Homo Sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 2672 - protein, 86 aa, Homo Sapiens
MGSNLSPQLCLMPFILGLLSGVRVSFWLLPVPCADTYLQIYGVLEHPEDSRPKDCQEGRVQSNPLSKTTRLRERGILAPVSLLQCE

SEQ ID NO: 2673 - protein, 305 aa, Homo Sapiens
  misc_feature (1)..(1): Xaa can be any naturally occurring amino acid
XDGLHNMGGDPITVIDEIRDLLYIGKDRKNPREDYLDVYVFGVGPLVNQVNINALASKKDNEQHVFKVKDMENLEDVFYQMIGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 2674 - protein, 68 aa, Homo Sapiens
  misc_feature (1)..(1): Xaa can be any naturally occurring amino acid
XPRFLCTGGVSPYADPNTCRGDSGGPLIVHKRSRFIQVSPPFPIWGDAKWSAWAPKQESSMHVASNSR

SEQ ID NO: 2675 - protein, 148 aa, Homo Sapiens
MTWRHHVRLLFTVSLALQIINLGNSYQREKHNGGREEVTKVATQKHRQSPLNWTSSHFGEVTGSAEGWGPEEPLPYSRAFGEDPKDFLASHAHGPSAGGAPSLLLLLPCALLHRLLRPDAPAHPRSLVPSVLQRERRPCGRPGLGHRL

SEQ ID NO: 2676 - protein, 223 aa, Homo Sapiens
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 2677 - protein, 191 aa, Homo Sapiens
MTWRHHVRLLFTVSLALQIINLGNSYQREKHNGGREEVTKVATQKHRQSPLNWTSSHFGEVTGSAEGWGPEEPLPYSRAFGEVNAAPWSTEPGPSAPATSAGASSGPCTASPSRRLTAVTRKTSWPPTLTGRAPGARPACYSCCPAHSCTASCARMRPRTLGPWSLPSSSGSGAPAEGRDLGIAFNFLCCK

SEQ ID NO: 2678 - protein, 148 aa, Homo Sapiens
MTWRHHVRLLFTVSLALQIINLGNSYQREKHNGGREEVTKVATQKHRQSPLNWTSSHFGEVTGSAEGWGPEEPLPYSWAFGEDPKDFLASHAHGPSAGGAPSLLLLLPCALLHRLLRPDAPAHPRSLVPSVLQRERRPCGRPGLGHRL

SEQ ID NO: 2679 - protein, 223 aa, Homo Sapiens
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 2680 - protein, 191 aa, Homo Sapiens
MTWRHHVRLLFTVSLALQIINLGNSYQREKHNGGREEVTKVATQKHRQSPLNWTSSHFGEVTGSAEGWGPEEPLPYSWAFGEVNAAPWSTEPGPSAPATSAGASSGPCTASPSRRLTAVTRKTSWPPTLTGRAPGARPACYSCCPAHSCTASCARMRPRTLGPWSLPSSSGSGAPAEGRDLGIAFNFLCCK

SEQ ID NO: 2681 - protein, 253 aa, Homo Sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 2682 - protein, 260 aa, Homo Sapiens
MHSWERLAVLVLLGAAACGEEAWAWAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 2683 - protein, 299 aa, Homo Sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 2684 - protein, 50 aa, Homo Sapiens
MSRRPAYCSLQFLGSSDPPASASPVDGTTGGEYSEDDVNELVKEDEVDGE

SEQ ID NO: 2685 - protein, 19 aa, Homo Sapiens
QANVPSALPSLPAGSGCVI

SEQ ID NO: 2686 - protein, 17 aa, Homo Sapiens
  misc_feature (1)..(1): Xaa can be any naturally occurring amino acid
XALPSLPAGSGKKKFDA

SEQ ID NO: 2687 - protein, 385 aa, Homo Sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSFTL

SEQ ID NO: 2688 - protein, 1231 aa, Homo Sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 2689 - protein, 449 aa, Homo Sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSFTL

SEQ ID NO: 2690 - protein, 271 aa, Homo Sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 2691 - protein, 330 aa, Homo Sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 2692 - protein, 270 aa, Homo Sapiens; identical to SEQ ID NO: 1650

SEQ ID NO: 2693 - protein, 254 aa, Homo Sapiens
MWLLVSVILISRISSVGGEAMFCDFPKINHGILYDEEKYKPFSQVPTGEVFYYSCEYNFVSPSKSFWTRITCAEEGWSPTPKCLRQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 2694 - protein, 269 aa, Homo Sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVNSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 2695 - protein, 195 aa, Homo Sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSDMVFCISY

SEQ ID NO: 2696 - protein, 330 aa, Homo Sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 2697 - protein, 232 aa, Homo Sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICITACIAFRAHAQKSCTCRGRNECLILNFC

SEQ ID NO: 2698 - protein, 232 aa, Homo Sapiens; identical to SEQ ID NO: 2697

SEQ ID NO: 2699 - protein, 201 aa, Homo Sapiens
MENGWSPPCRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 2700 - protein, 331 aa, Homo Sapiens
MLLLINVILTLWVSCANGQEVKPCDFPEIQHGGLYYKSLRRLYFPAAAGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 2701 - protein, 331 aa, Homo Sapiens
MLLLINVILTLWVSCANGQEVKPCDFPEIQHGGLYYKSLRRLYFPAAAGQSYSYYCDQNFVTPSGSYWDYIHCTQDGWSPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 2702 - protein, 577 aa, Homo Sapiens
MLLLINVILTLWVSCANGQVKPCDFPEIQHGGLYYKSLRRLYFPAAAGQSYSYYCDQNFVTPSGSYWDYIHCTQDGWSPTVPCLRTCSKSDVEIENGFISESSSIYILNEETQYNCKPGYATAEGNSSGSITCLQNGWSTQPICIKFCDMPVFENSRAKSNGMWFKLHDTLDYECYDGYESSYGNTTDSIVCGEDGWSHLPTCYNSSENCGPPPPISNGDTTSFPQKVYLPWSRVEYQCQSYYELQGSKYVTCSNGDWSEPPRCISMKPCEFPEIQHGHLYYENTRRPYFPVATGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 2703 - protein, 569 aa, Homo Sapiens
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 2704 - protein, 161 aa, Homo Sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQ

SEQ ID NO: 2705 - protein, 591 aa, Homo Sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAAARHPTIQGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 2706 - protein, 583 aa, Homo Sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 2707 - protein, 576 aa, Homo Sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 2708 - protein, 378 aa, Homo Sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGGKMKQISLDIFKGLHRVYAILEFCCIILK

SEQ ID NO: 2709 - protein, 167 aa, Homo Sapiens
MGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATR

SEQ ID NO: 2710 - protein, 469 aa, Homo Sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 2711 - protein, 415 aa, Homo Sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYP

SEQ ID NO: 2712 - protein, 469 aa, Homo Sapiens; identical to SEQ ID NO: 2710

SEQ ID NO: 2713 - protein, 62 aa, Homo Sapiens
MDYYRKYAAIFLVTLSVFLHVLHSAPDVQDCPECTLQENPFFSQPGAPILQCMGCCFSRAYP

SEQ ID NO: 2714 - protein, 101 aa, Homo Sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVRTSRSPEAF

SEQ ID NO: 2715 - protein, 116 aa, Homo Sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 2716 - protein, 147 aa, Homo Sapiens
MDYYRKYAAIFLVTLSVFLHVLHSAPDVQETGFHHVAQAALKLLSSSNPPTKASQSARITDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 2717 - protein, 116 aa, Homo Sapiens
MQLSFWSHCRCFCMFSIPLLMCRVRDQICDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 2718 - protein, 130 aa, Homo Sapiens; identical to SEQ ID NO: 74

SEQ ID NO: 2719 - protein, 155 aa, Homo Sapiens
MSKRLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGP

SEQ ID NO: 2720 - protein, 130 aa, Homo Sapiens
MGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAP

SEQ ID NO: 2721 - protein, 163 aa, Homo Sapiens
MSKGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 2722 - protein, 165 aa, Homo Sapiens
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 2723 - protein, 165 aa, Homo Sapiens; identical to SEQ ID NO: 2722

SEQ ID NO: 2724 - protein, 165 aa, Homo Sapiens
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 2725 - protein, 165 aa, Homo Sapiens; identical to SEQ ID NO: 2724

SEQ ID NO: 2726 - protein, 165 aa, Homo Sapiens; identical to SEQ ID NO: 2724

SEQ ID NO: 2727 - protein, 165 aa, Homo Sapiens; identical to SEQ ID NO: 2722

SEQ ID NO: 2728 - protein, 132 aa, Homo Sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPGNLDARLDGGEKAMQPQW

SEQ ID NO: 2729 - protein, 301 aa, Homo Sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 2730 - protein, 318 aa, Homo Sapiens
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 2731 - protein, 318 aa, Homo Sapiens; identical to SEQ ID NO: 2730

SEQ ID NO: 2732 - protein, 318 aa, Homo Sapiens; identical to SEQ ID NO: 2730

SEQ ID NO: 2733 - protein, 57 aa, Homo Sapiens
MLPLTMTVLILLLLPTGQAAPKDGVTRPDSEVQHQLLPNPFQPGQEQLGSPLPLCPP

SEQ ID NO: 2734 - protein, 112 aa, Homo Sapiens
MLTAALAPGAANSPTTNPVILIVDKVLETQDLNGDGLMTPAELINFPGVALRPYPPYIGVGPNSNMCSRSDLPEDSNTLYPGSHLWLRHALNSKGNLDARLDGGEKAMQPQW

SEQ ID NO: 2735 - protein, 440 aa, Homo Sapiens
MNGLKEVRYACAVLLWAPWHLVGSKGMGRGVGMRPQLCFRHSRPAFMCFIYKSWSDIYFEHSSMGSLLSVCESSLSRSPVFGAAGRSRQKMRLCLTQPICDTVADASFPRPLILFLVPVPGRMLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 2736 - protein, 359 aa, Homo Sapiens
MVRPMLLLSLGLLAGLLPALAACPQNCHCHSDLQHVICDKVGLQKIPKVSEKTKLLNLQRNNFPVLAANSFRAMPNLVSLHLQHCQIREVAAGAFRGLKQLIYLYLSHNDIRVLRAGAFDDLTELTYLYLDHNKVTELPRGLLSPLVNLFILQLNNNKIRELRAGAFQGAKDLRWLYLSENALSSLQPGALDDVENLAKFHVDRNQLSSYPSAALSKLRVVEELKLSHNPLKSIPDNAFQSFGRYLETLWLDNTNLEKFSDGAFLGVTTLKHVHLENNRLNQLPSNFPFDSLETLALTNNPWKCTCQLRGLRRWLEAKASRPDATCASPAKFKGQHIRDTDAFRSCKFPTKRSKKAGRH

SEQ ID NO: 2737 - protein, 359 aa, Homo Sapiens; identical to SEQ ID NO: 2736

SEQ ID NO: 2738 - protein, 42 aa, Homo Sapiens
  misc_feature (1)..(1): Xaa can be any naturally occurring amino acid
XASRPDATCASPAKFKGQHIRDTDAFRSCKFPTKRSKKAGRH

SEQ ID NO: 2739 - protein, 762 aa, Homo Sapiens
MEGPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 2740 - protein, 253 aa, Homo Sapiens [sequence omitted]

SEQ ID NO: 2741 - protein, 684 aa, Homo Sapiens
  misc_feature (1)..(1): Xaa can be any naturally occurring amino acid
XPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSARRTPIKGRQCGADKVGKEKGRL

SEQ ID NO: 2742 - protein, 57 aa, Homo Sapiens
FREVGPKNSYIAYIEDHSGNGTFVNTELVGKGKRRPLNNNSEIALSLSRNKVVPVER

SEQ ID NO: 2743 - protein, 137 aa, Homo Sapiens
MERLLYGIGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSS

SEQ ID NO: 2744 - protein, 172 aa, Homo Sapiens
MLRLLTSMVVMSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIED

SEQ ID NO: 2745 - protein, 121 aa, Homo Sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENG

SEQ ID NO: 2746 - protein, 161 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFK

SEQ ID NO: 2747 - protein, 165 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFNFCLF

SEQ ID NO: 2748 - protein, 298 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFNGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIK

SEQ ID NO: 2749 - protein, 207 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKEKILKIYSLS

SEQ ID NO: 2750 - protein, 207 aa, Homo Sapiens; identical to SEQ ID NO: 2749

SEQ ID NO: 2751 - protein, 514 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2752 - protein, 543 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2753 - protein, 514 aa, Homo Sapiens; identical to SEQ ID NO: 2751

SEQ ID NO: 2754 - protein, 543 aa, Homo Sapiens; identical to SEQ ID NO: 2752

SEQ ID NO: 2755 - protein, 289 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHDGRGRAV

SEQ ID NO: 2756 - protein, 543 aa, Homo Sapiens; identical to SEQ ID NO: 2752

SEQ ID NO: 2757 - protein, 203 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVVPVER

SEQ ID NO: 2758 - protein, 295 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREA

SEQ ID NO: 2759 - protein, 586 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2760 - protein, 452 aa, Homo Sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2761 - protein, 45 aa, Homo Sapiens
SSDPPASASQSAGIRGVRHHPRPVCSLIETGFHRVSQDGLHLLTS

SEQ ID NO: 2762 - protein, 276 aa, Homo Sapiens
  misc_feature (1)..(1): Xaa can be any naturally occurring amino acid
XIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFIWTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2763 - protein, 144 aa, Homo Sapiens
  misc_feature (1)..(1): Xaa can be any naturally occurring amino acid
XIISKRKFAIGSAREADPALNVETEIEILKKLNHPCIIKIKNFFDAEDYYIVLELMEGGELFDKVVGNKRLKEATCKLYFYQMLLAVQDEDMKRKFQDLLSEENESTALPQVLAQPSTSRKRPREGEAEGAETTKRPAVCAAVL

SEQ ID NO: 2764 - protein, 38 aa, Homo Sapiens
MRSAAVLALLLCAGQVTALPVNSPMNKGDTEMNGSFPF

SEQ ID NO: 2765 - protein, 457 aa, Homo Sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 2766 - protein, 306 aa, Homo Sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKGRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 2767 - protein, 289 aa, Homo Sapiens
MPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQE

SEQ ID NO: 2768 - protein, 677 aa, Homo Sapiens
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 2769 - protein, 383 aa, Homo Sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 2770 - protein, 152 aa, Homo Sapiens
  misc_feature (1)..(1): Xaa can be any naturally occurring amino acid
XLLLSAALSAGKVTIDSSYDIAKISQHLDFISIMTYDFHGAWRGTTGHHSPLFRGQEDASPDRFSNTICDFLRGATVHRILGQQVPYATKGNQWVGYDDQESVKSKVQYLKDRQLAGAMVWALDLDDFQGSFCGQDLRFPLTNAIKDALAAT

SEQ ID NO: 2771 - protein, 380 aa, Homo Sapiens
MGATTMDQKSLWAGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2772 - protein, 182 aa, Homo Sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDELAEAFQKDFTKSTKERLLLTAGVSAGRQMIDNSYQVEKLA

SEQ ID NO: 2773 - protein, 201 aa, Homo Sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 2774 - protein, 221 aa, Homo Sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKP

SEQ ID NO: 2775 - protein, 390 aa, Homo Sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2776 - protein, 390 aa, Homo Sapiens; identical to SEQ ID NO: 2775

SEQ ID NO: 2777 - protein, 145 aa, Homo Sapiens
MLYQTINSLKTKFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYY

SEQ ID NO: 2778 - protein, 122 aa, Homo Sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 2779 - protein, 169 aa, Homo Sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYA

SEQ ID NO: 2780 - protein, 311 aa, Homo Sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2781 - protein, 311 aa, Homo Sapiens; identical to SEQ ID NO: 2780

SEQ ID NO: 2782 - protein, 183 aa, Homo Sapiens
PDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 2783 - protein, 161 aa, Homo Sapiens
  misc_feature (1)..(1): Xaa can be any naturally occurring amino acid
XFTNWSQDRQEPGKFTPENIDPFLCSHLIYSFASIENNKVIIKDKSEVMLYQTINSLKTKNPKLKILLSIGGYLFGSKGDLDFINLLSFDFHGSWEKPLITGHNSPLSKGWQDRGPSSYYNVEYAVGYWIHKGMPSEKVVMGIPTYGHSFTLASAETTVGA

SEQ ID NO: 2784 - protein, 42 aa, Homo Sapiens
YEICQFLKGAKITRLQDQQVPYAVKGNQWVGYDDVKSMETKD

SEQ ID NO: 2785 - protein, 420 aa, Homo Sapiens
ETSSSVHEQVADSGAQAVAFQSGGESSIVWNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 2786 - protein, 315 aa, Homo Sapiens
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 2787 - protein, 315 aa, Homo Sapiens; identical to SEQ ID NO: 2786

SEQ ID NO: 2788 - protein, 287 aa, Homo Sapiens
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFW

SEQ ID NO: 2789 - protein, 315 aa, Homo Sapiens; identical to SEQ ID NO: 2786

SEQ ID NO: 2790 - protein, 476 aa, Homo Sapiens [sequence omitted]

SEQ ID NO: 2791 - protein, 476 aa, Homo Sapiens [sequence omitted]

SEQ ID NO: 2792 - protein, 368 aa, Homo Sapiens
MVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 2793 - protein, 101 aa, Homo Sapiens
MVSTPENRQTFITSVIKFLRQYEFDGLDFDWEYPGSRGSPPQDKHLFTVLVQMRKLKYREDLSNLPKITQLVGIITSSAVWPQSPLLLSITLGCPLLLRNA

SEQ ID NO: 2794 - protein, 69 aa, Homo Sapiens
LKDHRPRMVWDSQASEHFFEYKKSRSGRHVVFYPTLKSLQVRLELARELGVGVSIWELGQGLDYFYDLL

SEQ ID NO: 2795 - protein, 26 aa, Homo Sapiens
MRTLFNLLWLALACSPVHTTLSKSDA

SEQ ID NO: 2796 - protein, 84 aa, Homo Sapiens
MRTLFNLLWLALACSPVHTTLSKSDAKKAASKTLLEKAGAQWRDLGSPQPLPPRFKRFSCFSLPSSWDYRVSFQISRCKTGVWW

SEQ ID NO: 2797 - protein, 84 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGY

SEQ ID NO: 2798 - protein, 116 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRR

SEQ ID NO: 2799 - protein, 119 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGRE

SEQ ID NO: 2800 - protein, 224 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGAR

SEQ ID NO: 2801 - protein, 132 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQG

SEQ ID NO: 2802 - protein, 162 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGSHPSCLTVLAPQAEKSGGCELSGSMPRACT

SEQ ID NO: 2803 - protein, 393 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2804 - protein, 393 aa, Homo Sapiens; identical to SEQ ID NO: 2803

SEQ ID NO: 2805 - protein, 393 aa, Homo Sapiens; identical to SEQ ID NO: 2803

SEQ ID NO: 2806 - protein, 362 aa, Homo Sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2807 - protein, 38 aa, Homo Sapiens
MRTLFNLLWLALACSPVHTTLSKSDAKKAASKTLLEKV

SEQ ID NO: 2808 - protein, 418 aa, Homo Sapiens
MRTLFNLLWLALACSPVHTTLSKSDAKKAASKTLLEKVKFCSCCPGWSAMARSWLTATSATQSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2809 - protein, 418 aa, Homo Sapiens; identical to SEQ ID NO: 2808

SEQ ID NO: 2810 - protein, 84 aa, Homo Sapiens
  misc_feature (1)..(1): Xaa can be any naturally occurring amino acid
XDAREPVVGARYIQTLKDHRPRMVWDSQASEHFFEYKKSRSGRHVVFYPTLKSLQVRLELARELGVGVSIWELGQGLDYFYDLL

SEQ ID NO: 2811 - protein, 108 aa, Homo Sapiens
  misc_feature (1)..(1): Xaa can be any naturally occurring amino acid
XPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 2812 - protein, 72 aa, Homo Sapiens
  misc_feature (1)..(1): Xaa can be any naturally occurring amino acid
XQLGMFTHKEFEQLAPVLDGFSLMTYDYSTAHQPGPNAPLSWVRACVQVLDPKSKWRSKILLGLNFYGTSRH

SEQ ID NO: 2813 - protein, 447 aa, Homo Sapiens
MVRSVAWAGFMVLLMIPWGSAAKLVCYFTNWAQYRQGEARFLPKDLDPSLCTHLIYAFAGMTNHQLSTTEWNDETLYQEFNGLKKMFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 2814 - protein, 466 aa, Homo Sapiens
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 2815 - protein, 387 aa, Homo Sapiens
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELNG

SEQ ID NO: 2816 - protein, 361 aa, Homo Sapiens
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVMLTLRQGDCKMTDVQAA

SEQ ID NO: 2817 - protein, 66 aa, Homo Sapiens
MEPLLLGRGLIVYLMFLLLKFSKAIEIPSSVQQVPTIIKQSKVQVAFPFDEYFQIECEAKGNPEPT

SEQ ID NO: 2818 - protein, 85 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIP

SEQ ID NO: 2819 - protein, 96 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPN

SEQ ID NO: 2820 - protein, 181 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVY

SEQ ID NO: 2821 - protein, 1224 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 2822 - protein, 1171 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 2823 - protein, 1208 aa, Homo Sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 2824 - protein, 93 aa, Homo Sapiens
MPPAWSGESMDRGVVGLGSTKTQRGARAPPPQTAEGREGAPGAVVAMAPGSGARGAGDAGRGWSLLPLCASLFLSLFFFFWSVSVRGEAARRK

SEQ ID NO: 2825 - protein, 358 aa, Homo Sapiens
  misc_feature (1)..(1): Xaa can be any naturally occurring amino acid
XSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 2826 - protein, 23 aa, Homo Sapiens
MALTLFDTDEYRPPVWKSYCFMA

SEQ ID NO: 2827 - protein, 459 aa, Homo Sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 2828 - protein, 433 aa, Homo Sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 2829 - protein, 22 aa, Homo Sapiens
MALTLFDTDEYRPPVWKSYYIL

SEQ ID NO: 2830 - protein, 185 aa, Homo Sapiens
MATMGLLMLLTLAASPHFLSICFHHVCVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESA

SEQ ID NO: 2831 - protein, 275 aa, Homo Sapiens
MATMGLLMLLTLAASPHFLSICFHHVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 2832 - protein, 334 aa, Homo Sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 2833 - protein, 165 aa, Homo Sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCAVLEARKSKIKLAAGSVSDCGLNVHKQCSKMVPNDCKPDLKHVKKVYSCDLTTL

SEQ ID NO: 2834 - protein, 186 aa, Homo Sapiens
MRGGRNRDRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAY

SEQ ID NO: 2835 - protein, 173 aa, Homo Sapiens
MWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLM

SEQ ID NO: 2836 - protein, 194 aa, Homo Sapiens
MWGLIAQGVKCAVLEARKSKIKLAAGSVSDCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLK

SEQ ID NO: 2837 - protein, 613 aa, Homo Sapiens
MAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 2838 - protein, 775 aa, Homo Sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 2839 - protein, 298 aa, Homo Sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEVG

SEQ ID NO: 2840 - protein, 123 aa, Homo Sapiens
CHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQNCPKKAQG

SEQ ID NO: 2841 - protein, 90 aa, Homo Sapiens
MLSLARPPLPPTGLRTRTRYIQTELGSRERLLVAVLTSRATLSTLAVAVNRTVAHHFPRLLYFTGQRGARAPAGMQVVSHGDERPAWLMS

SEQ ID NO: 2842 - protein, 764 aa, Homo Sapiens
MLSLARPPLPPTGLRTSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 2843 - protein, 772 aa, Homo Sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 2844 - protein, 86 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEAGP

SEQ ID NO: 2845 - protein, 955 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 2846 - protein, 915 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 2847 - protein, 350 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGDSTPGAATARTSGQCLSPGTRLC

SEQ ID NO: 2848 - protein, 954 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPPETRTDPELEKEAEGS

SEQ ID NO: 2849 - protein, 94 aa, Homo Sapiens
MPSLPAPPAPLLLLGLLLLGSRPARGAGPEPPVLPIRSEKEPLPVRGAAGCTFGGKVYALDETWHPDLGEPFGVMRCVLCACEATGTLRPREMK

SEQ ID NO: 2850 - protein, 450 aa, Homo Sapiens
MGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 2851 - protein, 456 aa, Homo Sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 2852 - protein, 457 aa, Homo Sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 2853 - protein, 458 aa, Homo Sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 2854 - protein, 378 aa, Homo Sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 2855 - protein, 142 aa, Homo Sapiens
MALVGLPGPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTMRQVSNRMKRTVCSRSMG

SEQ ID NO: 2856 - protein, 93 aa, Homo Sapiens
MALVGLPGPDMFCLFHGKRYSPGESWHPYLEPQGLMYCLRCTCSENLTLPLDSGPHQSPASTTGPCTNTERSSVPMSCSPPACPTSVSSAAAQ

SEQ ID NO: 2857 - protein, 142 aa, Homo Sapiens
MALVGLPGPDMFCLFHGKRYSPGESWHPYLEPQGLMYCLRCTCSENLTLPLDSGPHQSPASTTGPCTNTERSSVPMSCSPPACPTSVSSAAAQRARSTAASQPAPNQAAQHPSRCQTPAARPAKMRQVSNRMKRTVCSRSMG

SEQ ID NO: 2858 - protein, 451 aa, Homo Sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 2859 - protein, 429 aa, Homo Sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGIFHLTQIKKVRKQDFQKEAQHFRLLAGPHEGHWNVFLAQTLELKVTASPDKVTKT

SEQ ID NO: 2860 - protein, 308 aa, Homo Sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKEDKADPGHSEISSTRCPKAPGRVLVHTSVSPSPDNLRRFALEHEASDLVEIYLWKLVK

SEQ ID NO: 2861 - protein, 281 aa, Homo Sapiens [sequence omitted]

SEQ ID NO: 2862 - protein, 91 aa, Homo Sapiens
  misc_feature (1)..(1): Xaa can be any naturally occurring amino acid
XGDRSRISKENRQKKTGFTVEATGRQGRGMTGNLPLDSDQESQEARLPERGTALPTARWPPRRSLERLPSPDPGAEGHGQSRQSDQDITKT

SEQ ID NO: 2863 - protein, 177 aa, Homo Sapiens
  misc_feature (1)..(1): Xaa can be any naturally occurring amino acid
XSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVTGTSS

SEQ ID NO: 2864 - protein, 507 aa, Homo Sapiens
MAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 2865 - protein, 19 aa, Homo Sapiens
MGPSCPVFLSFTKLSLWWL

SEQ ID NO: 2866 - protein, 50 aa, Homo Sapiens
MGPSCPVFLSFTKLSLWWLLLTPAGGEEAKRPPPRAPGDPLSSPSPTALP

SEQ ID NO: 2867 - protein, 81 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTS

SEQ ID NO: 2868 - protein, 514 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTSDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 2869 - protein, 108 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTN

SEQ ID NO: 2870 - protein, 529 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 2871 - protein, 154 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNRTAR

SEQ ID NO: 2872 - protein, 133 aa, Homo Sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVVRLSSHRWPEEGDPRPPTAFPLLLPLPQPCPHAQQ

SEQ ID NO: 2873 - protein, 160 aa, Homo Sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRLLKIGNS

SEQ ID NO: 2874 - protein, 468 aa, Homo Sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 2875 - protein, 182 aa, Homo Sapiens
  misc_feature (1)..(1): Xaa can be any naturally occurring amino acid
XRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWLLKIGNS

SEQ ID NO: 2876 - protein, 56 aa, Homo Sapiens
  misc_feature (1)..(1): Xaa can be any naturally occurring amino acid
XTLSIMVTVFAINIHHRSSSTHNAMAPLVRKIFLHTLPKLLCMRSHVDRLLKIGNS

SEQ ID NO: 2877 - protein, 429 aa, Homo Sapiens
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 2878 - protein, 380 aa, Homo Sapiens
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 2879 - protein, 158 aa, Homo Sapiens
MTPGALLMLLGALGAPLAPGVRGSEAEGRLREKLFSGYDSSVRPAREVGDRVRVSVGLILAQLISLNEKDEEMSTKVYLDLAVLECGGSSHPPASGGTSTSAEITAEWTDYRLSWDPAEHDGIDSLRITAESVWLPDVVLLNNNDGNFDVALDISVVV

SEQ ID NO: 2880 - protein, 501 aa, Homo Sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 2881 - protein, 37 aa, Homo Sapiens
MVVDRLFLWTFIIFTSVGTLVIFLDATYHLPPPDPFP

SEQ ID NO: 2882 - protein, 316 aa, Homo Sapiens
  misc_feature (1)..(1): Xaa can be any naturally occurring amino acid
XPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVA

SEQ ID NO: 2883 - protein, 172 aa, Homo Sapiens
MEGPVLTLGLLAALAVCGSWGLNEEERLIRHLFQEKGYNKELRPVAHKEESVDVALALTLSNLISLGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDA

SEQ ID NO: 2884 - protein, 502 aa, Homo Sapiens
MEGPVLTLGLLAALAVCGSWGLNEEERLIRHLFQEKGYNKELRPVAHKEESVDVALALTLSNLISLGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 2885 - protein, 108 aa, Homo Sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMQ

SEQ ID NO: 2886 - protein, 235 aa, Homo Sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFRERGVGDSPPAGQGQRGPQSPSGQPQPPGHHLLPHHPPQAPLLHHQHPGALRAHLLHGQPGLLPTG

SEQ ID NO: 2887 - protein, 171 aa, Homo Sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFRW

SEQ ID NO: 2888 - protein, 517 aa, Homo Sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 2889 - protein, 411 aa, Homo Sapiens
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 2890 - protein, 33 aa, Homo Sapiens
MHHQWLLLAACFWVIFMFMVASKFITLTFKDPD

SEQ ID NO: 2891 - protein, 64 aa, Homo Sapiens
MHHQWLLLAACFWVIFMFMVASKFITLTFKDPDVYSAKQEFLFLTTMPEVRKLPEEKHIPEELK

SEQ ID NO: 2892 - protein, 85 aa, Homo Sapiens
MHHQWLLLAACFWVIFMFMVASKFITLTFKDPDVYSAKQEFLFLTTMPEVRKLPEEKHIPEELKPTGKELPDSQLVQPLVYMERL

SEQ ID NO: 2893 - protein, 133 aa, Homo Sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQ

SEQ ID NO: 2894 - protein, 141 aa, Homo Sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVL

SEQ ID NO: 2895 - protein, 356 aa, Homo Sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 2896 - protein, 356 aa, Homo Sapiens; identical to SEQ ID NO: 2895

SEQ ID NO: 2897 - protein, 142 aa, Homo Sapiens
MQRKAGKKEHVQLRDKRNQEPQFRGNTARKCEPQAAEGRVSEWLRCDNMHHQWLLLAACFWVIFMFMVASKFITLTFKDPDVYSAKQEFLFLTTMPEVRKLPEEKHIPEELKPTGKELPDSQLVQPLVYMERLELIRNVCRD

SEQ ID NO: 2898 - protein, 347 aa, Homo Sapiens
MKPALLEVMRMNRICRMVLATCLGSFILVIFYFQIMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 2899 - protein, 72 aa, Homo Sapiens
MKPALLEVMRMNRICRMVLATCLGSFILVIFYFQIMRRNPFGVDICCRKGSRSPLQELYNPIQVSFKHSVSM

SEQ ID NO: 2900 - protein, 352 aa, Homo Sapiens
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 2901 - protein, 77 aa, Homo Sapiens
MKPALLEVMRMNRICRMVLATCLGSFILVIFYFQSMLHPVMRRNPFGVDICCRKGSRSPLQELYNPIQVSFKHSVSM

SEQ ID NO: 2902 - protein, 158 aa, Homo Sapiens
MRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRN

SEQ ID NO: 2903 - protein, 225 aa, Homo Sapiens [sequence omitted]

SEQ ID NO: 2904 - protein, 341 aa, Homo Sapiens
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCHPCRLRYDVVGKFETLAEDAAFVLGLAGASDLSFPGPPRPRGAAASRDLAARLFRDISPFYQRRLFDLYKMDFLLFNYSAPSYLRLL

SEQ ID NO: 2905 - protein, 386 aa, Homo Sapiens
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 2906 - protein, 386 aa, Homo Sapiens; identical to SEQ ID NO: 2905

SEQ ID NO: 2907 - protein, 411 aa, Homo Sapiens
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 2908 - protein, 99 aa, Homo Sapiens
MSRHLPWICDQRCSSPSSPGRWPPAARMWLPRFSSKTVTVLLLAQTTCLLLFIISRPGPSSPAGGEDRVHVLVLSSWRSGSSFLGQLFSQHPDVFYLME

SEQ ID NO: 2909 - protein, 395 aa, Homo Sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 2910 - protein, 395 aa, Homo Sapiens; identical to SEQ ID NO: 2909

SEQ ID NO: 2911 - protein, 486 aa, Homo Sapiens
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHLSARDAREAVHAWRERLSREQVRQVEAACAPAMRLLAYPRSGEEGDAEQPREGETPLEMDADGAT

SEQ ID NO: 2912 - protein, 178 aa, Homo Sapiens
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTP

SEQ ID NO: 2913 - protein, 424 aa, Homo Sapiens
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 2914 - protein, 424 aa, Homo Sapiens; identical to SEQ ID NO: 2913

SEQ ID NO: 2915 - protein, 424 aa, Homo Sapiens; identical to SEQ ID NO: 2913

SEQ ID NO: 2916 - protein, 53 aa, Homo Sapiens
EDVEVGRCVRRFAGVQCVWSYEDKRVRKPLLCNELKRCLSPNGKLSLCSSDGL

SEQ ID NO: 2917 - protein, 802 aa, Homo Sapiens
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 2918 - protein, 882 aa, Homo Sapiens
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 2919 - protein, 65 aa, Homo Sapiens
HILYGKIIHLEKPFAVLVKHTPGDQDCDELGRETGTRYLVTALIKDKILFKTRPKPIITSVPKKV

SEQ ID NO: 2920 - protein, 524 aa, Homo Sapiens
MKEPRIFPRERPTPWTRAPLPPRGRLDGSLGPQGGPVLNTGHPLGVNSDPFLMAAGSLGGNLTPFPRNPSPFPASSGSLASNPAPFPAGARDPSMASFPRGMNPTGTGAVSFPRPGGLLGPGPGPGPTLNPRTGALPGPGPLSNPRLGGLPGPGPMSNPRAGGLLGAGPDPRGGGPMGPGSGPNLRAGVLLTSGNGPPNPRPVGLGPGPNPNLRSGFLGTNPAPRSGVFPGPGLGPNPRPSGLGPGPNLDARAGGLLGTGSGLNLRMAGPQGLDLAPILRAAGLLGANSASFSQASGNMGTSPSSMARVPGPMGPNSGPSSRGIGLPGPNPSPMSRAPGPIGPNSAHFSRPVGPMGVNANPFPRGAGSSAFSQSSGTLASNPATFQRSAGLQGSNPTIFPRASGPLGPNPANFPRATGLQGPSPTTFPRSTGPLGPGQVTFPRPAAGHLGPSPAGPVGINPAPFTRPTGTLGLNPASFPRMNGPAGKSFVPFPRVGSLPGTNPAAFPRPGGPMAAMYPNGMLPP

SEQ ID NO: 2921 - protein, 12 aa, Homo Sapiens
MVQIVISRESLC

SEQ ID NO: 2922 - protein, 12 aa, Homo Sapiens
MVQIVISRESLC

SEQ ID NO: 2923 - protein, 121 aa, Homo Sapiens
MVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 2924 - protein, 121 aa, Homo Sapiens; identical to SEQ ID NO: 2923

SEQ ID NO: 2925 - protein, 58 aa, Homo Sapiens
MVQIVISSARAGGLAEWVLMELQGEIEARYSTGLAGNLLGDLHYTTEGYIGLQVPVHM

SEQ ID NO: 2926 - protein, 75 aa, Homo Sapiens
MVQIVISSARAGGLAEWVLMELQGEIEARYSTGLAGNLLGDLHYTTELHQAHWLQIQHLSRLVLVTQVWLLFQEG

SEQ ID NO: 2927 - protein, 99 aa, Homo Sapiens
MVQIVISSARAGGLAEWVLMELQGEIEARYSTGLAGNLLGDLHYTTEVRGLFFPCLMPQESKLHQGGAPRTQSEDCLRFVIQGLANLRCSLLVLPLPLQ

SEQ ID NO: 2928 - protein, 144 aa, Homo Sapiens
  misc_feature (1)..(1): Xaa can be any naturally occurring amino acid
XAVLAAAATAAGGSVVARWPRGAALGGRHCSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 2929 - protein, 104 aa, Homo Sapiens
  misc_feature (1)..(1): Xaa can be any naturally occurring amino acid
XSARGGGDGGGRFGCRPLAARRRARRPPLQGIPVLIVGHHILYGKIIHLEKPFAVLVKHTPGDQDCDELGRETGTRYLVTALIKDKILFKTRPKPIITSVPKKV

SEQ ID NO: 2930 - protein, 1184 aa, Homo Sapiens
MVGTKAWVFSFLVLEVTSVLGRQTMLTQSVRRVQPGKKNPSIFAKPADTLESPGEWTTWFNIDYPGGKGDYERLDAIRFYYGDRVCARPLRLEARTTDWTPAGSTGQVVHGSPREGFWCLNREQRPGQNCSNYTVRFLCPPGSLRRDTERIWSPWSPWSKCSAACGQTGVQTRTRICLAEMVSLCSEASEEGQHCMGQDCTACDLTCPMGQVNADCDACMCQDFMLHGAVSLPGGAPASGAAIYLLTKTPKLLTQTDSDGRFRIPGLCPDGKSILKITKVKFAPIVLTMPKTSLKAATIKAEFVRAETPYMVMNPETKARRAGQSVSLCCKATGKPRPDKYFWYHNDTLLDPSLYKHESKLVLRKLQQHQAGEYFCKAQSDAGAVKSKVAQLIVIASDETPCNPVPESYLIRLPHDCFQNATNSFYYDVGRCPVKTCAGQQDNGIRCRDAVQNCCGISKTEEREIQCSGYTLPTKVAKECSCQRCTETRSIVRGRVSAADNGEPMRFGHVYMGNSRVSMTGYKGTFTLHVPQDTERLVLTFVDRLQKFVNTTKVLPFNKKGSAVFHEIKMLRRKKPITLEAMETNIIPLGEVVGEDPMAELEIPSRSFYRQNGEPYIGKVKASVTFLDPRNISTATAAQTDLNFINDEGDTFPLRTYGMFSVDFRDEVTSEPLNAGKVKVHLDSTQVKMPEHISTVKLWSLNPDTGLWEEEGDFKFENQRRNKREDRTFLVGNLEIRERRLFNLDVPESRRCFVKVRAYRSERFLPSEQIQGVVISVINLEPRTGFLSNPRAWGRFDSVITGPNGACVPAFCDDQSPDAYSAYVLASLAGEELQAVESSPKFNPNAIGVPQPYLNKLNYRRTDHEDPRVKKTAFQISMAKPRPNSAEESNGPIYAFENLRACEEAPPSAAHFRFYQIEGDRYDYNTVPFNEDDPMSWTEDYLAWWPKPMEFRACYIKVKIVGPLEVNVRSRNMGGTHRQTVGKLYGIRDVRSTRDRDQPNVSAACLEFKCSGMLYDQDRVDRTLVKVIPQGSCRRASVNPMLHEYLVNHLPLAVNNDTSEYTMLAPLDPLGHNYGIYTVTDQDPRTAKEIALGRCFDGTSDGSSRIMKSNVGVALTFNCVERQVGRQSAFQYLQSTPAQSPAAGTVQGRVPSRRQQRASRGGQRQGGVVASLRFPRVAQQPLIN

SEQ ID NO: 2931 - protein, 1162 aa, Homo Sapiens
MASLLPLLCLCVVAAHLAGARDATPTEEPMATALGLERRSVYTGQPSPALEDWEARAVPAEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 2932 - protein, 1156 aa, Homo Sapiens
MASLLPLLCLCVVAAHLAGARDATPTEEPMATALGLERRSVYTGQPSPALEDWEEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 2933 - protein, 113 aa, Homo Sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGLF

SEQ ID NO: 2934 - protein, 152 aa, Homo Sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 2935 - protein, 120 aa, Homo Sapiens
MDNVQPKIKHRPFCFSVKGHVKMLRLALTVTSMTFFIIAQAPEPYIVITGFEVTVILFFILLYVLRLDRLMKWLFWPLLVFALVTAVCCLADGALIYRKLLFNPSGPYQKKPVHEKKEVL

SEQ ID NO: 2936 - protein, 99 aa, Homo Sapiens
MDNVQPKIKHRPFCFSVKGHVKMLRLDIINSLVTTVFMLIVSVLALIPETTTLTVGGGVFALVTAVCCLADGALIYRKLLFNPSGPYQKKPVHEKKEVL

SEQ ID NO: 2937 - protein, 33 aa, Homo Sapiens
MDNVQPKIKHRPFCFSVKGHVKMLRLHCLVVFM

SEQ ID NO: 2938 - protein, 67 aa, Homo Sapiens
MDNVQPKIKHRPFCFSVKGHVKMLRLVFALVTAVCCLADGALIYRKLLFNPSGPYQKKPVHEKKEVL

SEQ ID NO: 2939 - protein, 69 aa, Homo Sapiens
MAGPFSRLLSARPGLRLLALAGAGSLAAGFLLRPEPVRAASERRRLYPPRLFPSSIRSVVSWEERTEQI

SEQ ID NO: 2940 - protein, 148 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASK

SEQ ID NO: 2941 - protein, 417 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 2942 - protein, 417 aa, Homo Sapiens; identical to SEQ ID NO: 2941

SEQ ID NO: 2943 - protein, 298 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVVVGIK

SEQ ID NO: 2944 - protein, 222 aa, Homo Sapiens
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVV

SEQ ID NO: 2945 - protein, 58 aa, Homo Sapiens
MAGPFSRLLSARPGLRLLALAGAGSLAAGFLLRPEPVRAASERRRLYPPRYLLTCLTL

SEQ ID NO: 2946 - protein, 103 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIK

SEQ ID NO: 2947 - protein, 129 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQER

SEQ ID NO: 2948 - protein, 241 aa, Homo Sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMA

SEQ ID NO: 2949 - protein, 417 aa, Homo Sapiens; identical to SEQ ID NO: 2941

SEQ ID NO: 2950 - protein, 298 aa, Homo Sapiens; identical to SEQ ID NO: 2943

SEQ ID NO: 2951 - protein, 417 aa, Homo Sapiens; identical to SEQ ID NO: 2941

SEQ ID NO: 2952 - protein, 298 aa, Homo Sapiens; identical to SEQ ID NO: 2943

SEQ ID NO: 2953 - protein, 96 aa, Homo Sapiens
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMAS

SEQ ID NO: 2954 - protein, 203 aa, Homo Sapiens
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRG

SEQ ID NO: 2955 - protein, 914 aa, Homo Sapiens
MGPFKSSVFILILHLLEGALSNSLIQLNNNGYEGIVVAIDPNVPEDETLIQQIKDMVTQASLYLLEATGKRFYFKNVAILIPETWKTKADYVRPKLETYKNADVLVAESTPPGNDEPYTEQMGNCGEKGERIHLTPDFIAGKKLAEYGPQGRAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQNELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTMQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 2956 - protein, 914 aa, Homo Sapiens; identical to SEQ ID NO: 2955

SEQ ID NO: 2957 - protein, 225 aa, Homo Sapiens
MDLRAGDSWGMLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 2958 - protein, 215 aa, Homo Sapiens
MLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 2959 - protein, 170 aa, Homo Sapiens
MSMAVETFGFFMATVGLLMLGVTLPNSYWRVSTVHGNVITTNTIFENLWFSCATDSLGVYNCWEFPSMLALSGIAGLRCTNIGGLELSRKAKLAATAGALHILAGICGMVAISWYAFNITRDFFDPLYPGTKYELGPALYLGWSASLISILGGLCLCSACCCGSDEDPAA

SEQ ID NO: 2960 - protein, 148 aa, Homo Sapiens
MSMAVETFGFFMATVGLLMLGVTLPNSYWRVSTVHGNVITTNTIFENLWFSCATDSLGVYNCWEFPSMLALSGICGMVAISWYAFNITRDFFDPLYPGTKYELGPALYLGWSASLISILGGLCLCSACCCGSDEDPAASARRPYQAPV

SEQ ID NO: 2961 - protein, 128 aa, Homo Sapiens
MSMAVETFGFFMATVGLLMLGVTLPNSYWRVSTVHGNVITTNTIFENLWFSCATDSLGVYNCWEFPSMLALSGSTDSPASLSGGTGLLVRLMSIKGPCEGRRLASCRLSVRCKEAVCVQGIFRPAGHS

SEQ ID NO: 2962 - protein, 228 aa, Homo Sapiens
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 2963 - protein, 228 aa, Homo Sapiens; identical to SEQ ID NO: 2962

SEQ ID NO: 2964 - protein, 106 aa, Homo Sapiens
  misc_feature (1)..(1): Xaa can be any naturally occurring amino acid
XGNVITTNTIFENLWFSCATDSLGVYNCWEFPSMLALSGYIQACRALMITAILLGFLGLLLGIAGLRCTNIGGLELSRKAKLAATAGALHILADLLAANQPIGSVS

SEQ ID NO: 2965 - protein, 140 aa, Homo Sapiens
MANSGLQLLGFSMALLGWVGLVACTAIPQWQMSSYAGDNIITAQAMYKGLWMDCVTQSTGMMSCKIGLAGHSSPNGGLPGAGLPGHVCGHDGHEVHALWGRRQSEEGPYSHGWRHNFHRGRSCRLGSLLLVWPSDCHRLL

SEQ ID NO: 2966 - protein, 129 aa, Homo Sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVA

SEQ ID NO: 2967 - protein, 211 aa, Homo Sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRVPRSYPKSNSSKEYV

SEQ ID NO: 2968 - protein, 211 aa, Homo Sapiens; identical to SEQ ID NO: 2967

SEQ ID NO: 2969 - protein, 145 aa, Homo Sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGMSLALPSLLAGQGLP

SEQ ID NO: 2970 - protein, 194 aa, Homo Sapiens
MPEGTVGLPARRPQCFLRAEMANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSAL

SEQ ID NO: 2971 - protein, 100 aa, Homo Sapiens
MVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLS

SEQ ID NO: 2972 - protein, 72 aa, Homo Sapiens
FVSLGLMCFGALIGLCACICRSLYPTIATGILHLLAGLCTLGSVSCYVAGIELLHQKLELPDNPSTIKNVSP

SEQ ID NO: 2973 - protein, 155 aa, Homo Sapiens
KSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAAQYYKERFTIMTLQSWETYHKI

SEQ ID NO: 2974 - protein, 138 aa, Homo Sapiens
MAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLC

SEQ ID NO: 2975 - protein, 223 aa, Homo Sapiens
MAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYT

SEQ ID NO: 2976 - protein, 89 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMH

SEQ ID NO: 2977 - protein, 145 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPF

SEQ ID NO: 2978 - protein, 172 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIA

SEQ ID NO: 2979 - protein, 177 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILH

SEQ ID NO: 2980 - protein, 180 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLA

SEQ ID NO: 2981 - protein, 213 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFG

SEQ ID NO: 2982 - protein, 237 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAA

SEQ ID NO: 2983 - protein, 239 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHT

SEQ ID NO: 2984 - protein, 245 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYT

SEQ ID NO: 2985 - protein, 253 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 2986 - protein, 253 aa, Homo Sapiens; identical to SEQ ID NO: 2985

SEQ ID NO: 2987 - protein, 253 aa, Homo Sapiens; identical to SEQ ID NO: 2985

SEQ ID NO: 2988 - protein, 253 aa, Homo Sapiens; identical to SEQ ID NO: 2985

SEQ ID NO: 2989 - protein, 253 aa, Homo Sapiens; identical to SEQ ID NO: 2985

SEQ ID NO: 2990 - protein, 253 aa, Homo Sapiens; identical to SEQ ID NO: 2985

SEQ ID NO: 2991 - protein, 210 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAVTKESMLPAGAESKHTATPAHACVQTGKPK

SEQ ID NO: 2992 - protein, 106 aa, Homo Sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTGNCSCSRVI

SEQ ID NO: 2993 - protein, 100 aa, Homo Sapiens
MEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWS

SEQ ID NO: 2994 - protein, 122 aa, Homo Sapiens
MEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAA

SEQ ID NO: 2995 - protein, 87 aa, Homo Sapiens
MGESFDVVTKCVSFTLTEQFMEKFVDPGNHNSGIDLLRTYLWRCQFLLPFVSLGLMCFGALIGLCACICRSLYPTIATGILHLLAEN

SEQ ID NO: 2996 - protein, 158 aa, Homo Sapiens
MGESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 2997 - protein, 276 aa, Homo Sapiens
MGGDRLENKTSVSVASWSSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 2998 - protein, 317 aa, Homo Sapiens
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEDSECMTPPPSLPGPAHRLPEGAAPGPQVLPALARLRSSGGGAGAVHGAGREPGAAGRPPADGGAHSVPARGARSLQLARVAGRARSARRGPLPLRKRPARVLLRLASLTPPRARRPAQRLAASAQPGPAQRWHARELRGAGL

SEQ ID NO: 2999 - protein, 323 aa, Homo Sapiens
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFENGQRVSFFAWHRSPRPELGAQPSASPHPLSPDQPNGGTLENCVAQASDDGSWWDHDCQRRLYYVCEFPF

SEQ ID NO: 3000 - protein, 245 aa, Homo Sapiens
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQPSASPHPLSPDQPNGGTLENCVAQASDDGSWWDHDCQRRLYYVCEFPF

SEQ ID NO: 3001 - protein, 118 aa, Homo Sapiens
LAKGRIQARRMKMQRIAALLDLPIQPTTEVLGFGLGSSTSTQHLPFRFYDQGRRGSSDPTVQRSVFASVDKVPALLTAAVERQPRWPLPSLLVPWLTDCCGGLCLLIYRRFSRIVFKI

SEQ ID NO: 3002 - protein, 906 aa, Homo Sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGEPAPRPAPQLVHHGGRSRSFSLWSLCELPFLSQKPRRLAAPAS

SEQ ID NO: 3003 - protein, 1053 aa, Homo Sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 3004 - protein, 60 aa, Homo Sapiens
  misc_feature (1)..(1): Xaa can be any naturally occurring amino acid
XEVLGFGLGSSTSTQHLPFRFYDQGRRGSSDPTVQRSVFASVDKVPDPSLCSCISYMCQS

SEQ ID NO: 3005 - protein, 152 aa, Homo Sapiens
  misc_feature (1)..(1): Xaa can be any naturally occurring amino acid
XKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPAVRSGRKGRRRVFSLSEADSHGGHWV

SEQ ID NO: 3006 - protein, 128 aa, Homo Sapiens
  misc_feature (1)..(1): Xaa can be any naturally occurring amino acid
XMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFQG

SEQ ID NO: 3007 - protein, 446 aa, Homo Sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 3008 - protein, 446 aa, Homo Sapiens; identical to SEQ ID NO: 3007

SEQ ID NO: 3009 - protein, 455 aa, Homo Sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 3010 - protein, 446 aa, Homo Sapiens; identical to SEQ ID NO: 3007

SEQ ID NO: 3011 - protein, 446 aa, Homo Sapiens; identical to SEQ ID NO: 3007

SEQ ID NO: 3012 - protein, 66 aa, Homo Sapiens
MRRLLVWATSSQLGCGRHLCSAGQAAIEAFVCAYSPRGNWEVNGKTIVPYKKGAWCSLCTASVSGC

SEQ ID NO: 3013 - protein, 455 aa, Homo Sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 3014 - protein, 446 aa, Homo Sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPRGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 3015 - protein, 303 aa, Homo Sapiens [sequence omitted]

SEQ ID NO: 3016 - protein, 446 aa, Homo Sapiens; identical to SEQ ID NO: 3014

SEQ ID NO: 3017 - protein, 119 aa, Homo Sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLAS

SEQ ID NO: 3018 - protein, 446 aa, Homo Sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNNQRCKTRNRYICQFAQEHISRWGPGS

SEQ ID NO: 3019 - protein, 455 aa, Homo Sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNNQRCKTRNRYICQFAQEHISRWGPGS

SEQ ID NO: 3020 - protein, 446 aa, Homo Sapiens; identical to SEQ ID NO: 3018

SEQ ID NO: 3021 - protein, 446 aa, Homo Sapiens; identical to SEQ ID NO: 3018

SEQ ID NO: 3022 - protein, 446 aa, Homo Sapiens; identical to SEQ ID NO: 3018

SEQ ID NO: 3023 - protein, 134 aa, Homo Sapiens
MLHPETSPGRGHLLAVLLALLGTAWAEVWPPQLQEQAPMAGALNRKESFLLLSLHNRLRSWVQPPAADMRRLLVWATSSQLGCGRHLCSAGQAAIEAFVCAYSPRGNWEVNGKTIVPYKKGAWCSLCTASVSGC

SEQ ID NO: 3024 - protein, 86 aa, Homo Sapiens
MQRWTLWAAAFLTLHSAQAFPQTDISISPALPELPLPSLCPLFWMEFKGHCYRFFPLNKTWAEADLYCSEFSVGRKSAKLASIHSL

SEQ ID NO: 3025 - protein, 186 aa, Homo Sapiens
MQRWTLWAAAFLTLHSAQAFPQTDISISPALPELPLPSLCPLFWMEFKGHCYRFFPLNKTWAEADLYCSEFSVGRKSAKLASIHSWEENVFVYDLVNSCVPGIPADVWTGLHDHRQEGQFEWTDGSSYDYSYWDGSQPDDGVHADPEEEDCVQIWYRPTSALRSWNDNTCSRKFPFVCKIPSLTIH

SEQ ID NO: 3026 - protein, 136 aa, Homo Sapiens
MQRWTLWAAAFLTLHSAQAFPQTDISISPALPELPLPSLCPLFWMEFKGHCYRFFPLNKTWAEADLYCSEFSVGRKSAKLASIHSWEENVFVYDLVNSCVPGIPADVWTGLHDHRQVRKQWPLGPLGSSSQDSILI

SEQ ID NO: 3027 - protein, 65 aa, Homo Sapiens
MQRWTLWAAAFLTLHSAQAFPQTDISISPVCFLSAPSPARAAPAFPVPPVLDGVQRPLLSILPSQ

SEQ ID NO: 3028 - protein, 80 aa, Homo Sapiens
MILKLILSLKNFLRRYKCSSDHWIGLKMAKNRTGQWVDGATFTKSFGMRGSEGCAYLSDDGAATARCYTERKWICRKRIH

SEQ ID NO: 3029 - protein, 149 aa, Homo Sapiens
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 3030 - protein, 206 aa, Homo Sapiens
MAQQACPRAMAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 3031 - protein, 50 aa, Homo Sapiens
MAQQACPRAMAKNGLVICILVITLLLDQTTSHTSRLKARKHSKRRVRGIC

SEQ ID NO: 3032 - protein, 202 aa, Homo Sapiens
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 3033 - protein, 160 aa, Homo Sapiens
MFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 3034 - protein, 179 aa, Homo Sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIM

SEQ ID NO: 3035 - protein, 610 aa, Homo Sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 3036 - protein, 610 aa, Homo Sapiens; identical to SEQ ID NO: 3035

SEQ ID NO: 3037 - protein, 277 aa, Homo Sapiens
GCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGFHHVGQDSIELRTSSDPPILASQSAGITDVSHCTRPTIRILPQRGTLYYLSLALLPGWSTVVRPRLTATSASRIQTIFLPQPPK

SEQ ID NO: 3038 - protein, 204 aa, Homo Sapiens
GSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISDGETEAQRG

SEQ ID NO: 3039 - protein, 271 aa, Homo Sapiens
LMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGFHHVGQDSIELRTSSDPPILASQSAGITDVSHCTRPTIRILPQRGTLYYLLWTKTFLLCSLQFSWDFQNIATPYFNLLPKP

SEQ ID NO: 3040 - protein, 358 aa, Homo Sapiens
MAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 3041 - protein, 36 aa, Homo Sapiens
MEGDDDIEVFRLQAPVWEFKYGDLLGHLLLYLAPGR

SEQ ID NO: 3042 - protein, 407 aa, Homo Sapiens
MRRNLRLGPSSGADAQGQGAPRPGLAAPRMLLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 3043 - protein, 125 aa, Homo Sapiens
  misc_feature (1)..(1): Xaa can be any naturally occurring amino acid
XGRASWCWALALLWLAVVPGWSRVSGIPSRRHWPVPYKRFDFRPKPDPYCQAKYTFCPTGSPIPVMEGDDDIEVFRLQAPVWEFKYGDLLGHLVTWTHGCVTVAFIHVLSLHRKLCMMPLDSEVH

SEQ ID NO: 3044 - protein, 304 aa, Homo Sapiens
  misc_feature (1)..(1): Xaa can be any naturally occurring amino acid
XGYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 3045 - protein, 216 aa, Homo Sapiens
  misc_feature (1)..(1): Xaa can be any naturally occurring amino acid
XLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISDGETEAQRG

SEQ ID NO: 3046 - protein, 249 aa, Homo Sapiens
  misc_feature (1)..(1): Xaa can be any naturally occurring amino acid
XMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGFHHVGQDSIELRTSSDPPILASQSAGITDVSHCTRPTIRILPQRGTLYYLRWVLLCCPG

SEQ ID NO: 3047 - protein, 205 aa, Homo Sapiens
  misc_feature (1)..(1): Xaa can be any naturally occurring amino acid
XQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGKL

SEQ ID NO: 3048 - protein, 210 aa, Homo Sapiens
  misc_feature (1)..(1): Xaa can be any naturally occurring amino acid
XSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISEISCALKNGIKLAELGFLL

SEQ ID NO: 3049 - protein, 112 aa, Homo Sapiens
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 3050 - protein, 71 aa, Homo Sapiens
MEKILILLLVALSVAYAAPGPRGIIINLTLYGIYYKCPCERGLTCEGDKTIVGSITNTNFGICHDAGRSKQ

SEQ ID NO: 3051 - protein, 98 aa, Homo Sapiens
MILLPQPPKKLGLQENGELCMNSAQCKSNCCQHSSALGLARCTSMASENSECSVKTLYGIYYKCPCERGLTCEGDKTIVGSITNTNFGICHDAGRSKQ

SEQ ID NO: 3052 - protein, 42 aa, Homo Sapiens
GCCQRAPDNCESHCAEKGSEGSLCQTQLPATPCFLPSNTVRT

SEQ ID NO: 3053 - protein, 121 aa, Homo Sapiens
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 3054 - protein, 100 aa, Homo Sapiens
MAAALALVAGVLSGAVLPLWSALPQYKKKITDRCFHHSECYSGCCLMDLDSGGAFCAPRARITMICLPQTKGATNIICPCRMGLTCISKDLMCSRRCHMI

SEQ ID NO: 3055 - protein, 153 aa, Homo Sapiens
MAAALALVAGVLSGAVLPLWSALPQYKKKITDRCFHHSECYSGCCLMDLDSGGAFCAPRARITMICLPQWLELFKGRDRIIFIYEAPTPSLVSAHNQGSYQHHLPLPDGLDVHIQGLDVFPPVPYDLEEDAGWSLLPWGHRPWLPPTCSKSSS

SEQ ID NO: 3056 - protein, 633 aa, Homo Sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 3057 - protein, 268 aa, Homo Sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVKLCWHKP

SEQ ID NO: 3058 - protein, 130 aa, Homo Sapiens
MSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQK

SEQ ID NO: 3059 - protein, 129 aa, Homo Sapiens
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRV

SEQ ID NO: 3060 - protein, 142 aa, Homo Sapiens
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQ

SEQ ID NO: 3061 - protein, 154 aa, Homo Sapiens
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTP

SEQ ID NO: 3062 - protein, 134 aa, Homo Sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVR

SEQ ID NO: 3063 - protein, 956 aa, Homo Sapiens
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 3064 - protein, 968 aa, Homo Sapiens
MVLGCELSGSTRVVVGVEALLTGASSPLPGVGPANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 3065 - protein, 176 aa, Homo Sapiens
MVVITNKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFL

SEQ ID NO: 3066 - protein, 297 aa, Homo Sapiens
MEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCR

SEQ ID NO: 3067 - protein, 32 aa, Homo Sapiens
MMKTLLLFVGLLLTWESGQVLGDQTVSDNELQ

SEQ ID NO: 3068 - protein, 82 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKE

SEQ ID NO: 3069 - protein, 82 aa, Homo Sapiens; identical to SEQ ID NO: 3068

SEQ ID NO: 3070 - protein, 129 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVC

SEQ ID NO: 3071 - protein, 136 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLV

SEQ ID NO: 3072 - protein, 139 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQ

SEQ ID NO: 3073 - protein, 204 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTY

SEQ ID NO: 3074 - protein, 449 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 3075 - protein, 449 aa, Homo Sapiens; identical to SEQ ID NO: 3074

SEQ ID NO: 3076 - protein, 449 aa, Homo Sapiens; identical to SEQ ID NO: 3074

SEQ ID NO: 3077 - protein, 271 aa, Homo Sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDSLMPFSPYEPLNFHAMFQPFLEMIHEAQQAMDIHFHSPAFQHPPTEFIREGDDDRTVCREIRHNSTGCLRMKDQCDKC

SEQ ID NO: 3078 - protein, 140 aa, Homo Sapiens
  misc_feature (1)..(1): Xaa can be any naturally occurring amino acid
XADCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 3079 - protein, 284 aa, Homo Sapiens
  misc_feature (1)..(1): Xaa can be any naturally occurring amino acid
XQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPV

SEQ ID NO: 3080 - protein, 466 aa, Homo Sapiens
MKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 3081 - protein, 466 aa, Homo Sapiens; identical to SEQ ID NO: 3080

SEQ ID NO: 3082 - protein, 466 aa, Homo Sapiens; identical to SEQ ID NO: 3080

SEQ ID NO: 3083 - protein, 491 aa, Homo Sapiens
MNSMEAAVGTEVPLLDNLQHCNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 3084 - protein, 518 aa, Homo Sapiens
MRTWDYRWSLALVAQTGVHCCNLSSLQPLPPRFKRFSCLSLSSGWDYSNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 3085 - protein, 518 aa, Homo Sapiens; identical to SEQ ID NO: 3084

SEQ ID NO: 3086 - protein, 82 aa, Homo Sapiens
MRTWDYSNSGNMKPPLLVFIVCLLWLKDSHCAPTWKDKTAISENLKSFSEVGEIDADEEVKKALTGIKQMKIMMERKEKEHT

SEQ ID NO: 3087 - protein, 34 aa, Homo Sapiens
  misc_feature (1)..(1): Xaa can be any naturally occurring amino acid
XQFGWVSELANQAPETEIIFNSIQVRRSNASYIQ

SEQ ID NO: 3088 - protein, 136 aa, Homo Sapiens
MLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 3089 - protein, 247 aa, Homo Sapiens
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 3090 - protein, 179 aa, Homo Sapiens
MLSRCRSGLLHVLGLSFLLQTRRPILLCSPRLMKPLVVFVLGGPGAGKGTQCARIVEEMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 3091 - protein, 58 aa, Homo Sapiens
MLSRCRSGLLHVLGLSFLLQTRRPILLCSPRLMKPLVVFVLGGPGAGKGTQCARIVEG

SEQ ID NO: 3092 - protein, 228 aa, Homo Sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 3093 - protein, 169 aa, Homo Sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNENSDLPSVNKANY

SEQ ID NO: 3094 - protein, 436 aa, Homo Sapiens
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFVA

SEQ ID NO: 3095 - protein, 292 aa, Homo Sapiens [sequence omitted]

SEQ ID NO: 3096 - protein, 161 aa, Homo Sapiens
  misc_feature (1)..(1): Xaa can be any naturally occurring amino acid
XGCCNIYRSIIGFVKLRSNKVKRSQKLVYMGKLKEKESFGEISVLLQVPFTCTIITKKEVEMAIIEDKDLFELDPVTKQLMLQTAKPTFGHLTDEDVKNEYLKKEQQKEWKDFKIASWTKEITDFICLYEKHQDNFTLPKIAHLERITKRIKNNSILIHLE

SEQ ID NO: 3097 - protein, 207 aa, Homo Sapiens
  misc_feature (1)..(1): Xaa can be any naturally occurring amino acid
XNMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFELDPVTKQLMLQTAKPTFGHLTDEDVKNEYLKKEQQKEWKDFKDKTVKNSLYYKGIIPGFGKWDHYCTSIPRNLKDTLVNY

SEQ ID NO: 3098 - protein, 507 aa, Homo Sapiens
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 3099 - protein, 464 aa, Homo Sapiens
MDPKLGRMTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 3100 - protein, 38 aa, Homo Sapiens
  misc_feature (1)..(1): Xaa can be any naturally occurring amino acid
XADRGDGWLTDPYVLTEGNFMDEERPTTKALSWLGSML

SEQ ID NO: 3101 - protein, 61 aa, Homo Sapiens
ILQKILLDDTGLAYICQTYERFSHVAMILGKMVLQLSKEPSARLLKHVVRCYLRLSDNPRC

SEQ ID NO: 3102 - protein, 41 aa, Homo Sapiens
MHSLATAADLALLPRLECSGVILAHRNLDLLGSVDSPTSAS

SEQ ID NO: 3103 - protein, 299 aa, Homo Sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 3104 - protein, 299 aa, Homo Sapiens; identical to SEQ ID NO: 3103

SEQ ID NO: 3105 - protein, 258 aa, Homo Sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRFSDLTFCWSSFQRK

SEQ ID NO: 3106 - protein, 331 aa, Homo Sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIVETGFHHVGQADLELPTSSDLPASASQSAGITGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 3107 - protein, 75 aa, Homo Sapiens
MHSLATAAPVPTTLAQVDREKIYQWINELSSPETRENALLELSKKRESVPDLAPMLWHSFGTIAALLQVIVMQVI

SEQ ID NO: 3108 - protein, 80 aa, Homo Sapiens
KNYVRVVGRNGESSELDLQGIRIDSDISGTLKFACESIVEEYEDELIEFFSREADNVKDKLCSKRTDLCDHALHISHDEL

SEQ ID NO: 3109 - protein, 102 aa, Homo Sapiens
MGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSR

SEQ ID NO: 3110 - protein, 168 aa, Homo Sapiens
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRT

SEQ ID NO: 3111 - protein, 182 aa, Homo Sapiens
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 3112 - protein, 41 aa, Homo Sapiens
  misc_feature (1)..(1): Xaa can be any naturally occurring amino acid
XACRALVDELEWEIAQVDPKKTIQMGSFRINPDGSQSVVER

SEQ ID NO: 3113 - protein, 278 aa, Homo Sapiens [sequence omitted]

SEQ ID NO: 3114 - protein, 143 aa, Homo Sapiens
MDSMPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLIIACTRRGPAAIDLPRACQRPLRHYTTWYTKGSRW

SEQ ID NO: 3115 - protein, 36 aa, Homo Sapiens
MATLKGLVQKGVKVDLGIPLELWDEPSVEVTYLKKQ

SEQ ID NO: 3116 - protein, 248 aa, Homo Sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 3117 - protein, 118 aa, Homo Sapiens
  misc_feature (1)..(1): Xaa can be any naturally occurring amino acid
XCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQSG

SEQ ID NO: 3118 - protein, 372 aa, Homo Sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 3119 - protein, 372 aa, Homo Sapiens; identical to SEQ ID NO: 3118

SEQ ID NO: 3120 - protein, 256 aa, Homo Sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQH

SEQ ID NO: 3121 - protein, 372 aa, Homo Sapiens; identical to SEQ ID NO: 3118

SEQ ID NO: 3122 - protein, 57 aa, Homo Sapiens
KHSIEVPIPRDGEYVVEVRAHSDGGDGVVSQVKISEGKSTSLRSKTAKDHRSIRTMS

SEQ ID NO: 3123 - protein, 63 aa, Homo Sapiens
MKMWLLVSHLVIISITTCLAEFTWYRRYGHGVSEEDKGFGPIFEEQPINTIYPEESLEGKVSL

SEQ ID NO: 3124 - protein, 73 aa, Homo Sapiens
MKMWLLVSHLVIISITTCLAEFTWYRRYGHGVSEEDKGFGPIFEEQPINTIYPEESLEGKVSLNCRARASPFP

SEQ ID NO: 3125 - protein, 85 aa, Homo Sapiens
MKMWLLVSHLVIISITTCLAEFTWYRRYGHGVSEEDKGFGPIFEEQPINTIYPEESLEGKVSLNCRARASPFPVYKWRMNNGDVD

SEQ ID NO: 3126 - protein, 90 aa, Homo Sapiens
MKMWLLVSHLVIISITTCLAEFTWYRRYGHGVSEEDKGFGPIFEEQPINTIYPEESLEGKVSLNCRARASPFPVYKWRMNNGDVDLTSDR

SEQ ID NO: 3127 - protein, 1018 aa, Homo Sapiens
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 3128 - protein, 1018 aa, Homo Sapiens; identical to SEQ ID NO: 3127

SEQ ID NO: 3129 - protein, 627 aa, Homo Sapiens
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGKNRKGGEKNMVDSFLPVCASLPPTW

SEQ ID NO: 3130 - protein, 627 aa, Homo Sapiens; identical to SEQ ID NO: 3129

SEQ ID NO: 3131 - protein, 1007 aa, Homo Sapiens
MKMWLLVSHLVIISITTCLAVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 3132 - protein, 1040 aa, Homo Sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 3133 - protein, 1040 aa, Homo Sapiens; identical to SEQ ID NO: 3132

SEQ ID NO: 3134 - protein, 1085 aa, Homo Sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGEMALWDPIRTPPLESSPRPGRNTRHEQVEELERSAHLTILQSKEEGQALGPRALPPSPSSSSKDPDAVPDNSLGAPACPSG

SEQ ID NO: 3135 - protein, 1040 aa, Homo Sapiens; identical to SEQ ID NO: 3132

SEQ ID NO: 3136 - protein, 1040 aa, Homo Sapiens; identical to SEQ ID NO: 3132

SEQ ID NO: 3137 - protein, 764 aa, Homo Sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTAGQHSLADRPGAWRRCPVLCLQQRERPALHAL

SEQ ID NO: 3138 - protein, 41 aa, Homo Sapiens
MGTATRRKPHLLLVAAVALVSSSGEDTEAQKSSITFPRSHS

SEQ ID NO: 3139 - protein, 41 aa, Homo Sapiens; identical to SEQ ID NO: 3138

SEQ ID NO: 3140 - protein, 527 aa, Homo Sapiens
  misc_feature (1)..(1): Xaa can be any naturally occurring amino acid
XAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGAAPPLPLSPREIQDPPRYLRGSFPPRPTPISTRKGKWKAGRNQVQSSLRTASPPPFYPAPRTSPRAREGRRVQGEAEDQPAIANGLQSTVGVGLRRPPSRPLPGLQLAL

SEQ ID NO: 3141 - protein, 115 aa, Homo Sapiens
  misc_feature (1)..(1): Xaa can be any naturally occurring amino acid
XGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPK

SEQ ID NO: 3142 - protein, 473 aa, Homo Sapiens
  misc_feature (1)..(1): Xaa can be any naturally occurring amino acid
XIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTQRERPALHAL

SEQ ID NO: 3143 - protein, 1011 aa, Homo Sapiens
  misc_feature (1)..(1): Xaa can be any naturally occurring amino acid
XPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGAAPPLPLSPREIQDPPRYLRGSFPPRPTPISTRKGKWKAGRNQVQSSLRTASPPPFYPAPRTSPRAREGRRVQGEAEDQPAIANGLQSTVGVGLRRPPSRPLPGLQLALHKHDGGEHGSPPSTTPWHRHFPLRGDADPHRLPGALILEPLPLRRSWTPPPTDTASPFLLPRWPDTVPESGWF

SEQ ID NO: 3144 - protein, 1028 aa, Homo Sapiens
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 3145 - protein, 698 aa, Homo Sapiens
MEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 3146 - protein, 54 aa, Homo Sapiens
MRLPWELLVLQSFILCLADDSTLHGPIFIQEPSPVMFPLDSEEKKVKLNCEVKG

SEQ ID NO: 3147 - protein, 116 aa, Homo Sapiens
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKL

SEQ ID NO: 3148 - protein, 1026 aa, Homo Sapiens
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 3149 - protein, 1026 aa, Homo Sapiens; identical to SEQ ID NO: 3148

SEQ ID NO: 3150 - protein, 1026 aa, Homo Sapiens; identical to SEQ ID NO: 3148

SEQ ID NO: 3151 - protein, 232 aa, Homo Sapiens
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDVQYQLLSGEELMESQ

SEQ ID NO: 3152 - protein, 137 aa, Homo Sapiens
MRLPWELLVLQSFILCLAGSQTDFWSLLGVLPALEADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFA

SEQ ID NO: 3153 - protein, 143 aa, Homo Sapiens
NDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENESVHQGFGSGSAPL

SEQ ID NO: 3154 - protein, 1022 aa, Homo Sapiens [sequence omitted]

SEQ ID NO: 3155 - protein, 1084 aa, Homo Sapiens
LTEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 3156 - protein, 1026 aa, Homo Sapiens
MASSWKLMLFLSVTMCLSESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 3157 - protein, 1100 aa, Homo Sapiens
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 3158 - protein, 1100 aa, Homo Sapiens; identical to SEQ ID NO: 3157

SEQ ID NO: 3159 - protein, 911 aa, Homo Sapiens
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEV

SEQ ID NO: 3160 - protein, 390 aa, Homo Sapiens
MNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 3161 - protein, 120 aa, Homo Sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDT

SEQ ID NO: 3162 - protein, 1331 aa, Homo Sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 3163 - protein, 108 aa, Homo Sapiens
MSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 3164 - protein, 1288 aa, Homo Sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 3165 - protein, 1207 aa, Homo Sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 3166 - protein, 745 aa, Homo Sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEW

SEQ ID NO: 3167 - protein, 604 aa, Homo Sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRGLVTQ

SEQ ID NO: 3168 - protein, 1039 aa, Homo Sapiens
MEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVIPQMQKSN

SEQ ID NO: 3169 - protein, 380 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMELAHGLQDQNLKISLTVCHQTTQ

SEQ ID NO: 3170 - protein, 745 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEW

SEQ ID NO: 3171 - protein, 1288 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 3172 - protein, 605 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRGLVTQ

SEQ ID NO: 3173 - protein, 1207 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 3174 - protein, 652 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEW

SEQ ID NO: 3175 - protein, 966 aa, Homo Sapiens
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLKFAD

SEQ ID NO: 3176 - protein, 180 aa, Homo Sapiens
  misc_feature (1)..(1): Xaa can be any naturally occurring amino acid
XRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLGRSGPVDEGEPLVNADRRDSAVIGGVIAVEIFILLCITAIAIRIYQQRKLRKENESKVSKKEEC

SEQ ID NO: 3177 - protein, 167 aa, Homo Sapiens
  misc_feature (1)..(1): Xaa can be any naturally occurring amino acid
XSAAPGLTRTSDTIVLSQKEHLPVTQIVMTDTGQPHSEADYTLGPLLCRGDTRLLKVWRRESVIFEIFPSLFGRLRWEDGLSQGVQHKPGQDESFWNSASFNTETSYLHFPAFHGELTADVCFFFKTTVSSGVFMENLGITDFIRIELRGRLATLDKSQGTHYLAIK

SEQ ID NO: 3178 - protein, 116 aa, Homo Sapiens
MAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFG

SEQ ID NO: 3179 - protein, 91 aa, Homo Sapiens
MAVFRSGLLVLTTPLASLAPRLASILTSAARLVNHTLYVHLQPGMSLEGPAQPQSSPVQATFEVLDFITHLYAGADVHRHLDVRILLTNIR

SEQ ID NO: 3180 - protein, 147 aa, Homo Sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRL

SEQ ID NO: 3181 - protein, 219 aa, Homo Sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQ

SEQ ID NO: 3182 - protein, 564 aa, Homo Sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 3183 - protein, 564 aa, Homo Sapiens; identical to SEQ ID NO: 3182

SEQ ID NO: 3184 - protein, 98 aa, Homo Sapiens
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFIT

SEQ ID NO: 3185 - protein, 128 aa, Homo Sapiens
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPP

SEQ ID NO: 3186 - protein, 593 aa, Homo Sapiens
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 3187 - protein, 96 aa, Homo Sapiens
MRTPRLRAQPRGAVYQAPSPPPAPVVQNLAHPPEVVLTDFQTLDGSQYNPVKQQLVRYATSCYSCCPRLASVLLYSDYGIGEVPVEPLDVPLPSTI

SEQ ID NO: 3188 - protein, 438 aa, Homo Sapiens
MLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 3189 - protein, 193 aa, Homo Sapiens
MSAAWIPALGLAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQA

SEQ ID NO: 3190 - protein, 80 aa, Homo Sapiens
MSAAWIPALGLGVCLLLLPGPAGSEGAAPIAITCFTRGLDIRKEKADVLCPGGCPLEEFSVYGNIVYASVSSICGAAVHR

SEQ ID NO: 3191 - protein, 513 aa, Homo Sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTDVAERMSSTTVDSEERLLRGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAAK

SEQ ID NO: 3192 - protein, 550 aa, Homo Sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 3193 - protein, 494 aa, Homo Sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAAK

SEQ ID NO: 3194 - protein, 550 aa, Homo Sapiens; identical to SEQ ID NO: 3192

SEQ ID NO: 3195 - protein, 550 aa, Homo Sapiens; identical to SEQ ID NO: 3192

SEQ ID NO: 3196 - protein, 615 aa, Homo Sapiens
MSAAWIPALGLGVCLLLLPGPAGSEGAGEWGSWGASRRSQGLSTSGYKRDSDPAPWASALPPEEEGAKVEPPRGAPALTPAADLLLLTCFSHAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 3197 - protein, 202 aa, Homo Sapiens
MSAAWIPALGLGVCLLLLPGPAGSEGAGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDK

SEQ ID NO: 3198 - protein, 55 aa, Homo Sapiens
PIAITCFTRGLDIRKEKADVLCPGGCPLEEFSVYGNIVYASVSSICGAAVHRRQK

SEQ ID NO: 3199 - protein, 434 aa, Homo Sapiens
  misc_feature (1)..(1): Xaa can be any naturally occurring amino acid
XCKADIAFLIDGSFNIGQRRFNLQKNFVGKVALMLGIGTEGPHVGLVQASEHPKIEFYLKNFTSAKDVLFAIKEVGFRGGNSNTDITLEKYLFVMLKRSENQQTYLMNADVAERMSSTTVDSEERLLRGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 3200 - protein, 828 aa, Homo Sapiens
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKEISLDLKKTRDAAFKILNPMTVPRFFRLNSNNALIEFLLEGTPEIREHYLDSKKDVDRHLKSACEQFIQQQTKLFVEQLEEFMTKVSALKTMASQGGPKYTLSQQPWAQPAKVNDLAATAYKTIKTKLPVTLRSMSLYLSNKDTEFILFKPVRNNIQQVFQKFHALLKEEFSPEDIQIIACPSMEQLSLLLLVSK

SEQ ID NO: 3201 - protein, 444 aa, Homo Sapiens
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNGK

SEQ ID NO: 3202 - protein, 85 aa, Homo Sapiens
PEAAAERDAREKLALWDRRPDTTAPLTDRQTDSVLELKAAAENLPVPAEDMVPEVDLKSMKAQVEISLAQLSNSFIPWIIKVVCS

SEQ ID NO: 3203 - protein, 68 aa, Homo Sapiens
  misc_feature (1)..(1): Xaa can be any naturally occurring amino acid
XIDGQLFLIKHLLILREQIAPFHTEFTIKEISLDLKKTRGFSVKNNGQSGRPQVYSLTAALGTTSKGQ

SEQ ID NO: 3204 - protein, 51 aa, Homo Sapiens
MLPQIPFLLLVSLNLVHGVFYAERYQMPTGIKGPLPNTKTQFFIPYTIKSK

SEQ ID NO: 3205 - protein, 216 aa, Homo Sapiens
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGP

SEQ ID NO: 3206 - protein, 680 aa, Homo Sapiens
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 3207 - protein, 680 aa, Homo Sapiens; identical to SEQ ID NO: 3206

SEQ ID NO: 3208 - protein, 1767 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 3209 - protein, 1806 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 3210 - protein, 1818 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 3211 - protein, 780 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKMCCNLSFGILIPLQK

SEQ ID NO: 3212 - protein, 570 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDP

SEQ ID NO: 3213 - protein, 1690 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 3214 - protein, 736 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKVSYSVVLVKPGEHVCFSNLRQV

SEQ ID NO: 3215 - protein, 729 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKMCCNLSFGILIPLQK

SEQ ID NO: 3216 - protein, 756 aa, Homo Sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKVSFSFSLFYKKVIKFACDKRFVGRHDERKVVKLSLPLYLIYE

SEQ ID NO: 3217 - protein, 694 aa, Homo Sapiens
  misc_feature (1)..(1): Xaa can be any naturally occurring amino acid
XPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKDFRCHWFHWIPWVSRCQWRERCTGSSWQTRPSGSAWSNGSSRFKRCKRSHWETWAKGHFRWRWPSWPSR

SEQ ID NO: 3218 - protein, 200 aa, Homo Sapiens
YRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEVRSTRPEKVFVFQ

SEQ ID NO: 3219 - protein, 1736 aa, Homo Sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 3220 - protein, 1629 aa, Homo Sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 3221 - protein, 290 aa, Homo Sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 3222 - protein, 1650 aa, Homo Sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 3223 - protein, 624 aa, Homo Sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 3224 - protein, 1874 aa, Homo Sapiens
MECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQHSRFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 3225 - protein, 1899 aa, Homo Sapiens
MRSRLPPALAALGAALLLSSIEAEGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 3226 - protein, 3063 aa, Homo Sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 3227 - protein, 3062 aa, Homo Sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGTLLPL

SEQ ID NO: 3228 - protein, 2987 aa, Homo Sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 3229 - protein, 207 aa, Homo Sapiens
VIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVKT

SEQ ID NO: 3230 - protein, 756 aa, Homo Sapiens
VSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPEPYVPEGGAYLPEREPFIVPVEPERTAEYEDYGADEPAEEPPEPHRRWRRALPHGPGQ

SEQ ID NO: 3231 - protein, 638 aa, Homo Sapiens
  misc_feature (1)..(1): Xaa can be any naturally occurring amino acid
XKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTPPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNL

SEQ ID NO: 3232 - protein, 843 aa, Homo Sapiens
FDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEGKRIIE

SEQ ID NO: 3233 - protein, 149 aa, Homo Sapiens
GPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRGWMGIFLLDHPTLPSSPDHLPSLLFPGDGLLT

SEQ ID NO: 3234 - protein, 757 aa, Homo Sapiens [sequence omitted]

SEQ ID NO: 3235 - protein, 1796 aa, Homo Sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 3236 - protein, 1780 aa, Homo Sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRDLIPYNDYQH

SEQ ID NO: 3237 - protein, 534 aa, Homo Sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTSP

SEQ ID NO: 3238 - protein, 534 aa, Homo Sapiens; identical to SEQ ID NO: 3237

SEQ ID NO: 3239 - protein, 337 aa, Homo Sapiens
  misc_feature (1)..(1): Xaa can be any naturally occurring amino acid
XVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEV

SEQ ID NO: 3240 - protein, 1388 aa, Homo Sapiens
MAPRRNNGQCWCLLMLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 3241 - protein, 1374 aa, Homo Sapiens
MLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGKGAILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 3242 - protein, 235 aa, Homo Sapiens
GEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPG

SEQ ID NO: 3243 - protein, 224 aa, Homo Sapiens
GPPGSEGLPGPPGPAGPRGERGPQGNSGEKGDQGFQGQPGFPGPPGPPGFPGKVGSPGPPGPQAEKGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPK

SEQ ID NO: 3244 - protein, 308 aa, Homo Sapiens
KVYTRCFCLEEPQNSEVDAQLTGRISQKAERGAKVHQETAADECPPCVHGARDSNGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLP

SEQ ID NO: 3245 - protein, 1604 aa, Homo Sapiens
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 3246 - protein, 966 aa, Homo Sapiens
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGPPGIPGPPGPPGVPGLQVKGEKRMRSLGGRAHGSGWLLPAGPQGCCSPTPKTQTCHFSLLCLPASQGGKEGPLSL

SEQ ID NO: 3247 - protein, 687 aa, Homo Sapiens
GEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGQVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 3248 - protein, 1339 aa, Homo Sapiens
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 3249 - protein, 1519 aa, Homo Sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 3250 - protein, 1754 aa, Homo Sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 3251 - protein, 280 aa, Homo Sapiens
  misc_feature (1)..(1): Xaa can be any naturally occurring amino acid
XISVPGPPGPPGPPGPPGTMGASSGVRLWATRQAMLGQVHEVPEGWLIFVAEQEELYVRVQNGFRKVQDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWR

SEQ ID NO: 3252 - protein, 36 aa, Homo Sapiens
GPPGIQGIHQTLGGYYNKDNKGNDEHEAGGLKGDKV

SEQ ID NO: 3253 - protein, 1142 aa, Homo Sapiens
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 3254 - protein, 60 aa, Homo Sapiens
MRLTGPWKLWLWMSIFLLPASTSVTVRDKTGIQANSLPNHQMLFIAFKSLKQILLRLKRP

SEQ ID NO: 3255 - protein, 1464 aa, Homo Sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 3256 - protein, 154 aa, Homo Sapiens
MRSRRAFKDLRKEERGEGREVKNPSVPLRPGGKVVKLGVAVTTDNAPLPPVPVPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPG

SEQ ID NO: 3257 - protein, 1364 aa, Homo Sapiens
MLSFVDTRTLLLLAVTLCLATCQFFETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 3258 - protein, 1366 aa, Homo Sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 3259 - protein, 401 aa, Homo Sapiens
EHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGR

SEQ ID NO: 3260 - protein, 250 aa, Homo Sapiens
ERPLGEMGSPPAAGFVTLGRLAKARGPRSSSAAFQLQMLQIVCSDTWADEDRCCELPASRDGETCPAFVSACSCSSETPGPPGPQGPPGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGG

SEQ ID NO: 3261 - protein, 1284 aa, Homo Sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 3262 - protein, 1297 aa, Homo Sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPGGSEWRETGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 3263 - protein, 79 aa, Homo Sapiens
AKGDKGSPGFYGKKGAKGEKGNAGFPGLPGPAGEPGRHGKDGLMGSPGFKGEAGSPGAPGQDGTRGEPTCAYEFSHVKE

SEQ ID NO: 3264 - protein, 136 aa, Homo Sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLT

SEQ ID NO: 3265 - protein, 957 aa, Homo Sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 3266 - protein, 954 aa, Homo Sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFCLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 3267 - protein, 956 aa, Homo Sapiens [sequence omitted]

SEQ ID NO: 3268 - protein, 125 aa, Homo Sapiens
  misc_feature (1)..(1): Xaa can be any naturally occurring amino acid
XRETACEIPGFNGECLNGPSDVGSTPAPCICPPGKPGLQGPKGYQGIAGTPGVPGSPGIQGARGLPGYKGEPGRDGDKGDRGLPGFPGLHGMPGSKGEMGAKGDKGSPGFYGKKGSIDHTTKYSY

SEQ ID NO: 3269 - protein, 65 aa, Homo Sapiens
GEPGELGEPGLPGEVGMRGPQGPPGLPGPPGRVGAPVSEGTCLGRGSTPSPGIKNQVLASSSTCI

SEQ ID NO: 3270 - protein, 1626 aa, Homo Sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 3271 - protein, 1319 aa, Homo Sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 3272 - protein, 81 aa, Homo Sapiens
MHLRAHRTRRGKVSPTAKTKSLLHFIVLCVAGVVVHAQEQGIDILHQLGLGGKDVRHSSPATAVPSASTPLPQGVHLTESG

SEQ ID NO: 3273 - protein, 1714 aa, Homo Sapiens
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETGPVGLPGEVGMTGSIGEKGERGSPGPLGPQGEKGVMGYPGPPGVPGPIGPLGLPGHVGARGPPGSQGPKGQRGSRGPDGLLGEQGIQGAKGEKGDQGKRGPHGLIGKTGNPGERGFQGKPGLQGLPGSTGDRGLPGEPGLRGLQGDVGPPGEMGMEGPPGTEGESGLQGEPGAKGDVGTAGSVGGTGEPGLRGEPGAPGEEGLQGKDGLKGVPGGRGLPGEDGEKGEMGLPGIIGPLGRSGQTGLPGPEGIVGIPGQRGRPGKKGDKGQIGPTGEVGSRGPPGKIGKSGPKGARGTRGAVGHLGLMGPDGEPGIPGYRGHQGQPGPSGLPGPKGEKGYPGEDSTVLGPPGPRGEPGPVGDQGERGEPGAEGYKGHVGVPGLRGATGQQGPPGEPGDQGEQGLKGERGSEGNKGKKGAPGPSGKPGIPGLQGLLGPKGIQGYHGADGISGNPGKIGPPGKQGLPGIRGGPGRTGLAGAPGPPGVKGSSGLPGSPGIQGPKGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTGPRGEKGFRGETGPQGPRGQPGPPGPPGAPGPRKQMDINAAIQALIESNTALQMESYQNTEVTLIDHSEEIFKTLNYLSNLLHSIKNPLGTRDNPARICKDLLNCEQKVSDGKYWIDPNLGCPSDAIEVFCNFSAGGQTCLPPVSVTKLEFGVGKVQMNFLHLLSSEATHIITIHCLNTPRWTSTQTSGPGLPIGFKGWNGQIFKVNTLLEPKVLSDDCKIQDGSWHKATFLFHTQEPNQLPVIEVQKLPHLKTERKYYIDSSSVCFL

SEQ ID NO: 3274 - protein, 890 aa, Homo Sapiens
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETMESCSVTQAGAQWHDLGSLHPLPPGFKRFSCLSLPG

SEQ ID NO: 3275 - protein, 166 aa, Homo Sapiens
  misc_feature (1)..(1): Xaa can be any naturally occurring amino acid
XIKNPLGTRDNPARICKDLLNCEQKVSDGKYWIDPNLGCPSDAIEVFCNFSAGGQTCLPPVSVTKAFTIITPEIEEGRILPFLGNHEPLIKSSMIVLLPKYPHHHPHSSGSWHRIIIEGKKMGLCELCRGNRSSGEADSSCFHDQITSLISLIHKLNPRKTREVLG

SEQ ID NO: 3276 - protein, 439 aa, Homo Sapiens
MKLALLLPWACCCLCGSALATGFLYPFSAAALQQHGYPEPGAGSPGSGYASRRHWCHHTVTRTVSCQVQNGSETVVQRVYQSCRWPGPCANLVRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 3277 - protein, 441 aa, Homo Sapiens
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 3278 - protein, 714 aa, Homo Sapiens
LSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGLPGPVGDPGPKGSRGYIGLPGLFGLPGSDGERGLPGVPGKRGKMGMPVLLPQSSEARGGNSMPSEGALAGRHGSHL

SEQ ID NO: 3279 - protein, 1860 aa, Homo Sapiens
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 3280 - protein, 485 aa, Homo Sapiens
  misc_feature (1)..(1): Xaa can be any naturally occurring amino acid
XAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKG

SEQ ID NO: 3281 - protein, 80 aa, Homo Sapiens
ATTSSEATTTPRPLLSTPVDGAEDPRCLEALKPGNCGEYVVRWYYDKQVNSCARFWFSGCNGSGNRFNSEKECQETCIQG

SEQ ID NO: 3282 - protein, 142 aa, Homo Sapiens
FDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 3283 - protein, 130 aa, Homo Sapiens
GMPGTSIPGPPGPKGDRGGPGIPGFKGEPGLSIRGPKGVQGPRGPVGAPGLKGDGYPGVPGPRGLPGPPGPMGLRGVGDTGAKTLNTSHGLEDPSCPDCSFCHFSLAADIQPKWPALLQLIPASGTRQDG

SEQ ID NO: 3284 - protein, 67 aa, Homo Sapiens
KGNPGNAQKGEAGERGPGGIPGYKGDKQYSREDREVEHNNEKYVACLLPSPALLQQSSLTHHGTCSH

SEQ ID NO: 3285 - protein, 1125 aa, Homo Sapiens
MWNRYFVFYLLLLSAFTSQTVSGQRKKGPKSNLLARKSDVQGSICFIDIVFIVDSSESSKIALFDKQKDFVDSLSDKIFQLTPGRSLEYDIKLAALQFSSSVQIDPPFSSWKDLQTFKQKVKSMNLIGQGTFSYYAISNATRLLKREGRKDGVKVVLLMTDGIDHPKNPDVQSISEDARISGISFITIALSTVVNEAKLRLISGDSSSEPTLLLSDPTLVDKIQDRLDILFEKKCERKICECEKGDPGDPGPPGTHGNPGIKGERGPKGNPGNAQKGEAGERGPGGIPGYKGDKGERGECGKPGIKGDKGSPGPYGPKGPRGIQGITGPPGDPGPKGFQGNKGEPGPPGPYGSPGAPGIGQQGIKGERGQEGRPGAPGPIGVGEPGQPGPRGPEGVPGERGLPGEGFPGPKGEKGSEGPTGPQGLQGLSIKGEKGDIGPVGPQGPMGIPGIGSQGEQGIQGPIGPPGPQGPAGQGLPGSKGEVGQMGPTGPRGPVGIGVQGPKGEPGSIGLPGQPGVPGEDGAAGKKGEAGLPGARGPEGPPGKGQPGPKGDEGKKGSKGNQGQRGLPGPEGPKGEPGIMGPFGMPGTSIPGPPGPKGDRGGPGIPGFKGEPGLSIRGPKGVQGPRGPVGAPGLKGDGYPGVPGPRGLPGPPGPMGLRGVGDTGAKGEPGVRGPPGPSGPRGVGTQGPKGDTGQKGLPGPPGPPGYGSQGIKGEQGPQGFPGPKGTMGHGLPGQKGEHGERGDVGKKGDKGEIGEPGSPGKQGLQGPKGDLGLTKEEIIKLITEICGCGPKCKETPLELVFVIDSSESVGPENFQIIKNFVKTMADRVALDLATARIGIINYSHKVEKVANLKQFSSKDDFKLAVDNMQYLGEGTYTATALQAANDMFEDARPGVKKVALVITDGQTDSRDKEKLTEVVKNASDTNVEIFVIGVVKKNDPNFEIFHKEMNLIATDPEHVYQFDDFFTLQDTLKQKLFQKICEDFDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 3286 - protein, 1487 aa, Homo Sapiens
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 3287 - protein, 1418 aa, Homo Sapiens
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 3288 - protein, 1466 aa, Homo Sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 3289 - protein, 1163 aa, Homo Sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 3290 - protein, 90 aa, Homo Sapiens
  misc_feature (1)..(1): Xaa can be any naturally occurring amino acid
XRGAPGERGRPGLPGAAGARGNDGARGSDGQPGPPGPPGTAGFPGSPGAKGPPGINGSPGGKGEMGPAGIPGAPGLMGARGPPGPAGANG

SEQ ID NO: 3291 - protein, 1669 aa, Homo Sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 3292 - protein, 519 aa, Homo Sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPLLFQIHK

SEQ ID NO: 3293 - protein, 223 aa, Homo Sapiens
MQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRV

SEQ ID NO: 3294 - protein, 105 aa, Homo Sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDV

SEQ ID NO: 3295 - protein, 1712 aa, Homo Sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 3296 - protein, 42 aa, Homo Sapiens
  misc_feature (1)..(1): Xaa can be any naturally occurring amino acid
XGDPGQHGLPGFPGLKVRSNFIMKLARHSEASPGVPFLPFIS

SEQ ID NO: 3297 - protein, 199 aa, Homo Sapiens
ATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMKAYSINCESWGIRKNNKSLSGVHEEKTLKLKKTAELLFFILKNKVMTEHAVI

SEQ ID NO: 3298 - protein, 156 aa, Homo Sapiens
GNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPVPAAPSL

SEQ ID NO: 3299 - protein, 1670 aa, Homo Sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 3300 - protein, 155 aa, Homo Sapiens
VRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLDALFVKVLRSP

SEQ ID NO: 3301 - protein, 1690 aa, Homo Sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 3302 - protein, 296 aa, Homo Sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIG

SEQ ID NO: 3303 - protein, 73 aa, Homo Sapiens
FASRNDYSYWLSTPEPMPMSMQPLKGQSIQPFISRCAVCEAPAVVIAVHSQTIQIPHCPQGWDSLWIGYSFMM

SEQ ID NO: 3304 - protein, 695 aa, Homo Sapiens
MGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKVIFGI

SEQ ID NO: 3305 - protein, 1691 aa, Homo Sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 3306 - protein, 1685 aa, Homo Sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 3307 - protein, 40 aa, Homo Sapiens
MKLRGVSLAAGLFLLALSLWGQPAEAAEETLFATPVTQAF

SEQ ID NO: 3308 - protein, 174 aa, Homo Sapiens
  misc_feature (1)..(1): Xaa can be any naturally occurring amino acid
XDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKMIRRYVLGFVASPK

SEQ ID NO: 3309 - protein, 115 aa, Homo Sapiens
  misc_feature (1)..(1): Xaa can be any naturally occurring amino acid
XGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLVNLSQKR

SEQ ID NO: 3310 - protein, 1690 aa, Homo Sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3311 - protein, 1707 aa, Homo Sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGDCCCREVGKGDLDTERGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3312 - protein, 1633 aa, Homo Sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3313 - protein, 1678 aa, Homo Sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3314 - protein, 1666 aa, Homo Sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3315 - protein, 1691 aa, Homo Sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 3316 - protein, 1838 aa, Homo Sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 3317 - protein, 1838 aa, Homo Sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 3318 - protein, 210 aa, Homo Sapiens
  misc_feature (1)..(1): Xaa can be any naturally occurring amino acid
XRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCA

SEQ ID NO: 3319 - protein, 1499 aa, Homo Sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 3320 - protein, 1112 aa, Homo Sapiens
MPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 3321 - protein, 1745 aa, Homo Sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 3322 - protein, 1028 aa, Homo Sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 3323 - protein, 1026 aa, Homo Sapiens [sequence omitted]

SEQ ID NO: 3324 - protein, 250 aa, Homo Sapiens
GNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCGSEVSPVPPDDPATPPDCEKRCGALDVVFVIDSSESIGYTNFTLEKNFVINVVNRLGAIAKDPKSETGTRVGVVQYSHEGTFEAIQLDDERIDSLSSFKEAVKN

SEQ ID NO: 3325 - protein, 180 aa, Homo Sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERA

SEQ ID NO: 3326 - protein, 1019 aa, Homo Sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 3327 - protein, 828 aa, Homo Sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTGLDGAVLC

SEQ ID NO: 3328 - protein, 918 aa, Homo Sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTDAPWPGGEPPVTFLRTEEGPDATFPRTIPLIQQLLNATELTQDPAAYSQLVAVLVYTAERAKFATGVERQDWMELFIDTFKLVHRDIVGDPETALALC

SEQ ID NO: 3329 - protein, 828 aa, Homo Sapiens; identical to SEQ ID NO: 3327

SEQ ID NO: 3330 - protein, 2971 aa, Homo Sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 3331 - protein, 1237 aa, Homo Sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 3332 - protein, 2971 aa, Homo Sapiens; identical to SEQ ID NO: 3330

SEQ ID NO: 3333 - protein, 3177 aa, Homo Sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 3334 - protein, 708 aa, Homo Sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKI

SEQ ID NO: 3335 - protein, 2569 aa, Homo Sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPFHGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 3336 - protein, 2570 aa, Homo Sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 3337 - protein, 1036 aa, Homo Sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 3338 - protein, 173 aa, Homo Sapiens
PIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQEYGLNENW

SEQ ID NO: 3339 - protein, 557 aa, Homo Sapiens
IGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDGEDTRSS

SEQ ID NO: 3340 - protein, 2611 aa, Homo Sapiens
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSLFKNAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 3341 - protein, 2615 aa, Homo Sapiens
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSPCWKEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 3342 - protein, 443 aa, Homo Sapiens
NQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDL

SEQ ID NO: 3343 - protein, 778 aa, Homo Sapiens
  misc_feature (1)..(1): Xaa can be any naturally occurring amino acid
XEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLW

SEQ ID NO: 3344 - protein, 2263 aa, Homo Sapiens
MMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPGAPGVDSSIEGPTGLKGERGRQGRRGWPGPPGTPGSRRKTAAHGRRGHTGPQGTAGIPGPDGLEGSLGLKGPQGPRGEAGVKGEKGGVGSKGPQGPPGPGGEAGNQGRLGSQGNKGEPGDLGEKGAVGFPGPRGLQGNDGSPGYGSVGRKGAKGQEGFPGESGPKGEIGDPGGPGETGLKGARGKMISAGLPGEMGSPGEPGPPGRKGVKGAKGLASFSTCELIQYVRDRSPGRHGKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAIDDTGTFQVIVVPSGADYIPALERLQRCTFCYDVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRRAINKYPPINLKIKCNRLNSIDPKQPPRPFRSFVPGPLKATLKEDVLQKAKFFQDKKYLSRVARSGRDDAIQNFMRSTSHTFKNGRMIESAPKQHD

SEQ ID NO: 3345 - protein, 298 aa, Homo Sapiens
  misc_feature (1)..(1): Xaa can be any naturally occurring amino acid
XLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPVSARAANWS

SEQ ID NO: 3346 - protein, 259 aa, Homo Sapiens
  misc_feature (1)..(1): Xaa can be any naturally occurring amino acid
XTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRLHVKRVVDFFKKQGSERMERKGPPGFKGSEGYLGEEGIAGERGAPGPVGEQGTKGCYGTKGPKGNRGLNGQEGEVGENGIDGLNGEQGDNGLPGR

SEQ ID NO: 3347 - protein, 173 aa, Homo Sapiens
MSALACGLPVPVPCLNSHLSMGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKG

SEQ ID NO: 3348 - protein, 2944 aa, Homo Sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 3349 - protein, 114 aa, Homo Sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLA

SEQ ID NO: 3350 - protein, 202 aa, Homo Sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPH

SEQ ID NO: 3351 - protein, 744 aa, Homo Sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 3352 - protein, 744 aa, Homo Sapiens; identical to SEQ ID NO: 3351

SEQ ID NO: 3353 - protein, 703 aa, Homo Sapiens
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 3354 - protein, 703 aa, Homo Sapiens; identical to SEQ ID NO: 3353

SEQ ID NO: 3355 - protein, 638 aa, Homo Sapiens
MPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 3356 - protein, 112 aa, Homo Sapiens
MAWTARDRGALGLLLLGLCLCAAQRGPPGEQGPPGPPGPPGVPGIDGIDGDRGPKGPPGPPGPAGEPGKPGAPGKPGTPGADAGVQWHDLGSLQPLPPGFKRFSCLSLQLPE

SEQ ID NO: 3357 - protein, 678 aa, Homo Sapiens
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 3358 - protein, 921 aa, Homo Sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 3359 - protein, 328 aa, Homo Sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADTSP

SEQ ID NO: 3360 - protein, 689 aa, Homo Sapiens
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 3361 - protein, 83 aa, Homo Sapiens
MAAATASPRSLLVLLQVVVLALAQIRGPPGERGPPGPPGPPGVPGSDGIDGPPGPVGLPGEIGIRGPKGDPGPDGPSGPPGPP

SEQ ID NO: 3362 - protein, 11 aa, Homo Sapiens
MGIPGVKGQPG

SEQ ID NO: 3363 - protein, 143 aa, Homo Sapiens
MGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYP

SEQ ID NO: 3364 - protein, 684 aa, Homo Sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 3365 - protein, 191 aa, Homo Sapiens
MWWSSTQNAGTEGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQ

SEQ ID NO: 3366 - protein, 277 aa, Homo Sapiens
MNGFASLLRRNQFILLVLFLLQIQSLGLDIDSRPTAEVCATHTISPGPKGDDGEKGDPGEEGKHGKVGRMGPKGIKGELGDMGDQGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 3367 - protein, 123 aa, Homo Sapiens
MKKQRGVGVLPALRMRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEP

SEQ ID NO: 3368 - protein, 285 aa, Homo Sapiens
MKKQRGVGVLPALRMRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3369 - protein, 116 aa, Homo Sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPAPSAPQR

SEQ ID NO: 3370 - protein, 271 aa, Homo Sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3371 - protein, 247 aa, Homo Sapiens
MRGNLALVGVLISLAFLSLLPSGHPQPAGDDACSVQILVPGLKGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3372 - protein, 268 aa, Homo Sapiens
MTPALCRSSSLASKGMRERRETKAPPDGLEESAPREKKQSQPVVTASDISKRKCTSSFVEMGSQGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3373 - protein, 245 aa, Homo Sapiens
MWWVPPSPYGCLPCALPGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3374 - protein, 221 aa, Homo Sapiens
MWWVPPSPYGCLPCALPGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3375 - protein, 221 aa, Homo Sapiens
MWWVPPSPYGCLPCALPGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3376 - protein, 197 aa, Homo Sapiens
MWWVPPSPYGCLPCALPGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 3377 - protein, 622 aa, Homo Sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 3378 - protein, 138 aa, Homo Sapiens
MDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAV

SEQ ID NO: 3379 - protein, 218 aa, Homo Sapiens
  misc_feature (1)..(1): Xaa can be any naturally occurring amino acid
XKAASRNLAFYPPHPDYTWSFDDIIVFAFSCKQAVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYV

SEQ ID NO: 3380 - protein, 626 aa, Homo Sapiens
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 3381 - protein, 363 aa, Homo Sapiens
MFSDCWLCPSLGSSGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 3382 - protein, 234 aa, Homo Sapiens
MLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 3383 - protein, 194 aa, Homo Sapiens
ISGLLCYSAGCLALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPP

SEQ ID NO: 3384 - protein, 445 aa, Homo Sapiens
MTGSSFSLAHLLIISGLLCYSAGCLALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 3385 - protein, 421 aa, Homo Sapiens
MVVLNPMTLGIYLQLFFLSIVSQPTFINSVLPISAALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 3386 - protein, 455 aa, Homo Sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 3387 - protein, 456 aa, Homo Sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRDCHRAYCGDGHRHEGVEDCDGSDFGYLTCETYLPGSYGDLQCTQYCYIDSTPCRYFT

SEQ ID NO: 3388 - protein, 724 aa, Homo Sapiens
MLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 3389 - protein, 704 aa, Homo Sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 3390 - protein, 757 aa, Homo Sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 3391 - protein, 123 aa, Homo Sapiens
LGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILERGPL

SEQ ID NO: 3392 - protein, 326 aa, Homo Sapiens
MAAAAAAAAATNGTGGSSGMEVDAAVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 3393 - protein, 327 aa, Homo Sapiens
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 3394 - protein, 42 aa, Homo Sapiens
MACGVTGSVSVALHPLVILNISDHWIRMRSQEGRPVQVIGAL

SEQ ID NO: 3395 - protein, 468 aa, Homo Sapiens
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 3396 - protein, 200 aa, Homo Sapiens
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSGTDYGLCKQMSTPLLKKDYVDEKEHPAQDPSYIFSRSYLI

SEQ ID NO: 3397 - protein, 111 aa, Homo Sapiens
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSVGRLLRGPDNV

SEQ ID NO: 3398 - protein, 54 aa, Homo Sapiens
MIFTFMTRKSCCSKQVQRKYWRNCQKLTATGSAPFPLALQRFSVVLVPGTISAT

SEQ ID NO: 3399 - protein, 262 aa, Homo Sapiens
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVAR

SEQ ID NO: 3400 - protein, 393 aa, Homo Sapiens
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 3401 - protein, 443 aa, Homo Sapiens
MRGQGPPLSSFGVWLASRAASDPSRPRRQGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 3402 - protein, 86 aa, Homo Sapiens
MRGQGPPLSSFGVWLASRAASDPSRPRRQGYDIHFHDKKILLLEAGPKKVLEKLSETYSNRVSSISPGSATLLSSVGRLLRGPDNV

SEQ ID NO: 3403 - protein, 105 aa, Homo Sapiens
MPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 3404 - protein, 225 aa, Homo Sapiens
GAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEASSETHRRIWNVIYPITVSVIILFQISTKE

SEQ ID NO: 3405 - protein, 1065 aa, Homo Sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 3406 - protein, 946 aa, Homo Sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHWTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHLLRLTGEYGM

SEQ ID NO: 3407 - protein, 179 aa, Homo Sapiens [sequence omitted]

SEQ ID NO: 3408 - protein, 852 aa, Homo Sapiens
VVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGEYPDTKSG

SEQ ID NO: 3409 - protein, 103 aa, Homo Sapiens
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVW

SEQ ID NO: 3410 - protein, 331 aa, Homo Sapiens
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 3411 - protein, 269 aa, Homo Sapiens
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAI

SEQ ID NO: 3412 - protein, 419 aa, Homo Sapiens
MRGLLVLSVLLGAVFGKEDFVGHQVLRISVADEAQVQKVKELEDLEHLQLDFWRGPAHPGSPIDVRVPFPSIQAVKIFLESHGISYETMIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 3413 - protein, 191 aa, Homo Sapiens
SLTFPPGSSMRGLLVLSVLLGAVFGKEDFVGHQVLRISVADEAQVQKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTA

SEQ ID NO: 3414 - protein, 419 aa, Homo Sapiens
MAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 3415 - protein, 182 aa, Homo Sapiens
MRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKKSSGRMQKDDGQLNPKPQRQTP

SEQ ID NO: 3416 - protein, 417 aa, Homo Sapiens
MRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFTDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLAKVAKIGTDVLSTRYETRYIYGPIESTIYPISGSSLDWAYDLGIKHTFAFELRDKGKFGFLLPESRIKPTCRETMLAVKFIAKYILKHTS

SEQ ID NO: 3417 - protein, 29 aa, Homo Sapiens
MQHNEGQERSSNNFNYGAYHSLEAIYHEM

SEQ ID NO: 3418 - protein, 317 aa, Homo Sapiens
MQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 3419 - protein, 421 aa, Homo Sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 3420 - protein, 172 aa, Homo Sapiens [sequence omitted]

SEQ ID NO: 3421 - protein, 177 aa, Homo Sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQIYHEMDNIAADFPDLARRVKIGHSFENRPMYVLKFSTGKGVRRPAVWLNAGIHSREWISQATAIWTARKIVSDYQRDPAITS

SEQ ID NO: 3422 - protein, 388 aa, Homo Sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 3423 - protein, 92 aa, Homo Sapiens
MKCLGKRRGQAAAFLPLCWLFLKILQPGHSHLYNNRYAGDKVIRFIPKTEEEAYALKKISYQLKGPHRRSSENTGEGKQLAHPEKPKIPLWI

SEQ ID NO: 3424 - protein, 92 aa, Homo Sapiens; identical to SEQ ID NO: 3423

SEQ ID NO: 3425 - protein, 437 aa, Homo Sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 3426 - protein, 175 aa, Homo Sapiens
LLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALAGREAEWS

SEQ ID NO: 3427 - protein, 550 aa, Homo Sapiens
MAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLEVFQELEDYDVSDSFGVSREDGPFWWAGLTAQRRRRSSVFPWPWGITKDSGFAFTVRRGNGTGGDDRPSEPEPPAGRWPLHR

SEQ ID NO: 3428 - protein, 1932 aa, Homo Sapiens
MAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 3429 - protein, 503 aa, Homo Sapiens
MSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLEVFQELEDYDVSDSFGVSREDGPFWWAGLTAQRRRRSSVFPWPWGITKDSGFAFTVRRGNGTGGDDRPSEPEPPAGRWPLHR

SEQ ID NO: 3430 - protein, 56 aa, Homo Sapiens
RTQTLSLKGRRRTERLLFLTAALLRAGRHHLAASCPYQPVTLYGGWADLSPGDTCL

SEQ ID NO: 3431 - protein, 338 aa, Homo Sapiens
  misc_feature (1)..(1): Xaa can be any naturally occurring amino acid
XVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDSQSGFSS

SEQ ID NO: 3432 - protein, 59 aa, Homo Sapiens
MLALLVLVTVALASAHHGGEHFEGEKVFRVNVEDENHINIIRELASTTQIDFWKPDSVT

SEQ ID NO: 3433 - protein, 99 aa, Homo Sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRN

SEQ ID NO: 3434 - protein, 417 aa, Homo Sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 3435 - protein, 417 aa, Homo Sapiens; identical to SEQ ID NO: 3434

SEQ ID NO: 3436 - protein, 203 aa, Homo Sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETVGKAGQNKPAIFMDCGFHAREWISPAFCQWFVREAVRTYGREIQVTELLDKLDFYVLPVLNIDGYIYTWTKSRFWRKTR

SEQ ID NO: 3437 - protein, 423 aa, Homo Sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 3438 - protein, 423 aa, Homo Sapiens; identical to SEQ ID NO: 3437

SEQ ID NO: 3439 - protein, 386 aa, Homo Sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 3440 - protein, 476 aa, Homo Sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 3441 - protein, 139 aa, Homo Sapiens
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGD

SEQ ID NO: 3442 - protein, 147 aa, Homo Sapiens
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYD

SEQ ID NO: 3443 - protein, 157 aa, Homo Sapiens
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEY

SEQ ID NO: 3444 - protein, 108 aa, Homo Sapiens
  misc_feature (1)..(1): Xaa can be any naturally occurring amino acid
XLGAEAQEPGAPAAGMRRRRRLQQEDGISFEYHRYPELREALVSVWLQCTAISRIYTVGRSFEGRELLVIELSDNPGVHEPDCKLYEVGTLIPAPSSCLAHSGLEYTL

SEQ ID NO: 3445 - protein, 64 aa, Homo Sapiens
MDFPCLWLGLLLPLVAALDFNYHRQEGMEAFLKTVAQNYSSVTHLHSIGKSVKDCWAGAAAPSD

SEQ ID NO: 3446 - protein, 64 aa, Homo Sapiens; identical to SEQ ID NO: 3445

SEQ ID NO: 3447 - protein, 72 aa, Homo Sapiens
MDFPCLWLGLLLPLVAALDFNYHRQEGMEAFLKTVAQNYSSVTHLHSIGKSVKETCGFLLWGGFQRNTELGF

SEQ ID NO: 3448 - protein, 136 aa, Homo Sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKP

SEQ ID NO: 3449 - protein, 249 aa, Homo Sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFP

SEQ ID NO: 3450 - protein, 443 aa, Homo Sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 3451 - protein, 443 aa, Homo Sapiens; identical to SEQ ID NO: 3450

SEQ ID NO: 3452 - protein, 443 aa, Homo Sapiens; identical to SEQ ID NO: 3450

SEQ ID NO: 3453 - protein, 35 aa, Homo Sapiens
SCPMIPLYRNLPDHSAATKPSLFLFLVSLLHIFFK

SEQ ID NO: 3454 - protein, 198 aa, Homo Sapiens
  misc_feature (1)..(1): Xaa can be any naturally occurring amino acid
XPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKLRSFACNRGQDEFCLTSLMS

SEQ ID NO: 3455 - protein, 204 aa, Homo Sapiens
MHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAE

SEQ ID NO: 3456 - protein, 458 aa, Homo Sapiens
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 3457 - protein, 545 aa, Homo Sapiens
MLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPQQGSLGLQYNASQEWDLRSSCGSLRLTVSIEARAAGP

SEQ ID NO: 3458 - protein, 545 aa, Homo Sapiens; identical to SEQ ID NO: 3457

SEQ ID NO: 3459 - protein, 374 aa, Homo Sapiens
MKPLLETLYLLGMLVPGGLGYDRSLAQHRQEIVDKSVSPWSLETYSYNIYHPMGEIYEWMREISEKYKEVVTQHFLGVTYETHPMYYLKISQPSGNPKKIIWMDCGIHAREWIAPAFCQWFVKEILQNHKDNSSIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 3460 - protein, 130 aa, Homo Sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKI

SEQ ID NO: 3461 - protein, 131 aa, Homo Sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIA

SEQ ID NO: 3462 - protein, 137 aa, Homo Sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGS

SEQ ID NO: 3463 - protein, 186 aa, Homo Sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQY

SEQ ID NO: 3464 - protein, 472 aa, Homo Sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 3465 - protein, 130 aa, Homo Sapiens
  misc_feature (1)..(1): Xaa can be any naturally occurring amino acid
XFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 3466 - protein, 141 aa, Homo Sapiens
IIGGYAEFLYQIGLLDEKQKKYFQKQCHECIEHIRKQNWFEAFEVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 3467 - protein, 100 aa, Homo Sapiens
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHL

SEQ ID NO: 3468 - protein, 142 aa, Homo Sapiens
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPA

SEQ ID NO: 3469 - protein, 244 aa, Homo Sapiens
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNY

SEQ ID NO: 3470 - protein, 6 aa, Homo Sapiens
MVGAMW

SEQ ID NO: 3471 - protein, 43 aa, Homo Sapiens
MVGAMWKVIVSLVLLMPGPCDGLFRSLYRSVSMPPKGDSGQPL

SEQ ID NO: 3472 - protein, 52 aa, Homo Sapiens
MVGAMWKVIVSLVLLMPGPCDGLFRSLYRSVSMPPKGDSGQPLFLTPYIEAG

SEQ ID NO: 3473 - protein, 476 aa, Homo Sapiens
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 3474 - protein, 476 aa, Homo Sapiens; identical to SEQ ID NO: 3473

SEQ ID NO: 3475 - protein, 476 aa, Homo Sapiens; identical to SEQ ID NO: 3473

SEQ ID NO: 3476 - protein, 180 aa, Homo Sapiens
  misc_feature (1)..(1): Xaa can be any naturally occurring amino acid
XKYFQKQCHECIEHIRKQNWFEAFEEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 3477 - protein, 734 aa, Homo Sapiens
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 3478 - protein, 224 aa, Homo Sapiens
MEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTGRVSLQKLSLACRRVRCAFALSSSSTMIVRPPQPYGTVPHSSPDPVTTKISPLRNF

SEQ ID NO: 3479 - protein, 756 aa, Homo Sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 3480 - protein, 515 aa, Homo Sapiens
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 3481 - protein, 641 aa, Homo Sapiens
MPPPLPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 3482 - protein, 652 aa, Homo Sapiens
MPPPLPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 3483 - protein, 69 aa, Homo Sapiens
MPPPLPLLLLTVLVVAAARPGCEFERNPAGECHRPPAADSGTVPGPPWLLFCRRAAAPTLSEHFRQLNP

SEQ ID NO: 3484 - protein, 388 aa, Homo Sapiens
IGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGF

SEQ ID NO: 3485 - protein, 569 aa, Homo Sapiens
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGHRLIGHSSAECILSGNTAHWSMKPPICQQIFCPNPPAILNGRHTGTPLGDIPYGKEVSYTCDPHPDRGMTFNLIGESTIRRTSEPHGNGVWSSPAPRCELPVGAGSHDALIVGKFYEVFAEEFCHL

SEQ ID NO: 3486 - protein, 1176 aa, Homo Sapiens
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRWDGWAGGWAANAPWGYGGAEKSARSVDESLPFPGPHVLICDMRRTV

SEQ ID NO: 3487 - protein, 1285 aa, Homo Sapiens
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 3488 - protein, 953 aa, Homo Sapiens
MAMEPGALWTFLGHLWLLAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 3489 - protein, 220 aa, Homo Sapiens
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 3490 - protein, 290 aa, Homo Sapiens
MSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYMTAKDPVVADLMKNPMASLMLPESEGEFCRKNIVDPEDPRCVQLTLTGQMIAVSPEEVEFAKQAMFSRHPGMRKWPRQYEWFFMKMRIEHIWLQKWYGGASSISREEYFKAVPRKA

SEQ ID NO: 3491 - protein, 422 aa, Homo Sapiens
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPGAFPILTDLTPETTRRWKLGSHPHSTYVKMKMQRDEATFPGLYGKQVAKLGSQSRQSDRGTRLIHSQQASSQR

SEQ ID NO: 3492 - protein, 420 aa, Homo Sapiens
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 3493 - protein, 420 aa, Homo Sapiens; identical to SEQ ID NO: 3492

SEQ ID NO: 3494 - protein, 420 aa, Homo Sapiens; identical to SEQ ID NO: 3492

SEQ ID NO: 3495 - protein, 101 aa, Homo Sapiens
MAPWPPKGLVPAMLWGLSLFLNLPGPIWLQPSPPPQSSPPPQPHPCHTCRGLVDSFNKGLERTIRDNFGGGNTAWEEENLSKYKDSLSWGNREALRWLRAV

SEQ ID NO: 3496 - protein, 100 aa, Homo Sapiens
  misc_feature (1)..(1): Xaa can be any naturally occurring amino acid
XPAHLSADIDECGTEGANCGADQFCVNTEGSYECRDCAKACLGCMGAGPGRCKKCSPGYQQMWMSVRQRCVRERTSSVKTPRAVIAASVPRATSRWKASV

SEQ ID NO: 3497 - protein, 229 aa, Homo Sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACV

SEQ ID NO: 3498 - protein, 353 aa, Homo Sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 3499 - protein, 321 aa, Homo Sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEDVDECSLAEKTCVRKNENCYNTPGSYVCVCPDGFEETEDACVPPAEAEATEGESPTQLPSREDL

SEQ ID NO: 3500 - protein, 325 aa, Homo Sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 3501 - protein, 402 aa, Homo Sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTVRTGLSDSYPPCCLSLGCWRGVGHAWIRGRNTHTQPGYSSRVWIAAFSPACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 3502 - protein, 196 aa, Homo Sapiens
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 3503 - protein, 322 aa, Homo Sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 3504 - protein, 238 aa, Homo Sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKVSCLLVS

SEQ ID NO: 3505 - protein, 375 aa, Homo Sapiens
MGGHPQLRLVKALLLLGLNPVSASLQDQHCESLSLASNISDNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 3506 - protein, 154 aa, Homo Sapiens
MGGHPQLRLVKALLLLGLNPVSASLQDQHCESLSLASNISEKKQGALPCRSHHQLPGPLYLPGGPPGGLCPLSAAQEHPVPAKHHPLEPHLRLHPAQRHLVRGPANHEPRGPPEQRGLVQVGDSRLQLLPCDQLLLDVRRGLLPAHSHRAHLLH

SEQ ID NO: 3507 - protein, 430 aa, Homo Sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 3508 - protein, 444 aa, Homo Sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 3509 - protein, 415 aa, Homo Sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 3510 - protein, 401 aa, Homo Sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 3511 - protein, 145 aa, Homo Sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLS

SEQ ID NO: 3512 - protein, 314 aa, Homo Sapiens
MVSATIPQKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 3513 - protein, 52 aa, Homo Sapiens
  misc_feature (1)..(1): Xaa can be any naturally occurring amino acid
XCWFGKRPGVYTDYIYQGPMILVLLEGCESHSGAAAPPGHHLHAVLRQSRGG

SEQ ID NO: 3514 - protein, 75 aa, Homo Sapiens
  misc_feature (1)..(1): Xaa can be any naturally occurring amino acid
XCWFGKRPGVYTDYIYQGPMILVLLINFIFLFNIVRILMTKLRASTTSETIQYRASLCLCSTVSSIVRSVLPSGR

SEQ ID NO: 3515 - protein, 93 aa, Homo Sapiens
  misc_feature (1)..(1): Xaa can be any naturally occurring amino acid
XSLASNISGLQCNASVDLIGTCWPRSPAGQLVVRPCPAFFYGVRYNTTNNGYRECLANGSWAARVNYSECQEILNEEEPGPQAQPGRAHRGGT

SEQ ID NO: 3516 - protein, 152 aa, Homo Sapiens
YGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVVCPSPSLWPGPLGSCTTTMRSAGLAKGLGCTPTTSTRAP

SEQ ID NO: 3517 - protein, 411 aa, Homo Sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 3518 - protein, 387 aa, Homo Sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGESWVSKEAQAAGPHGREKPEQRW

SEQ ID NO: 3519 - protein, 397 aa, Homo Sapiens
MGREPWPEDRDLGFPQLFCQGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 3520 - protein, 438 aa, Homo Sapiens
MRGPSGPPGLLYVPHLLLCLLCLLPPPLQYAAGQSQMPKDQPLWALLEQYCHTIMTLTNLSGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 3521 - protein, 64 aa, Homo Sapiens
MRGPSGPPGLLYVPHLLLCLLCLLPPPLQYAAGQSQMPKDQPLWALLEQYCHTIMTLTNLSGWS

SEQ ID NO: 3522 - protein, 64 aa, Homo Sapiens; identical to SEQ ID NO: 3521

SEQ ID NO: 3523 - protein, 99 aa, Homo Sapiens
MRGPSGPPGLLYVPHLLLCLLCLLPPPLQYAAGQSQMPKDQPLWALLEQYCHTIMTLTNLSVTPGAHSHSLSARGCGTRWTRHCSTACWRPTAAWRWLK

SEQ ID NO: 3524 - protein, 178 aa, Homo Sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHD

SEQ ID NO: 3525 - protein, 178 aa, Homo Sapiens; identical to SEQ ID NO: 3524

SEQ ID NO: 3526 - protein, 249 aa, Homo Sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 3527 - protein, 249 aa, Homo Sapiens; identical to SEQ ID NO: 3526

SEQ ID NO: 3528 - protein, 243 aa, Homo Sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 3529 - protein, 243 aa, Homo Sapiens; identical to SEQ ID NO: 3528

SEQ ID NO: 3530 - protein, 278 aa, Homo Sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAMKTYLNKREGINVWKCFLRLRHFQLLRGEQLLTFSGNNMNRKNTPYQQGTPCAGCPDDCDKGLCTNSCQYQDLLSNCDSLKNTAGCEHELLKEKCKATCLCENKIY

SEQ ID NO: 3531 - protein, 276 aa, Homo Sapiens
MKQILHPALETTACTNHFNADPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 3532 - protein, 258 aa, Homo Sapiens
MKQILHPALETTAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 3533 - protein, 191 aa, Homo Sapiens
MKQILHPALETTDPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYV

SEQ ID NO: 3534 - protein, 268 aa, Homo Sapiens
MKQILHPALETTDPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 3535 - protein, 112 aa, Homo Sapiens
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRV

SEQ ID NO: 3536 - protein, 210 aa, Homo Sapiens
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGV

SEQ ID NO: 3537 - protein, 19 aa, Homo Sapiens
MSCVLGGVIPLGLLFLVCG

SEQ ID NO: 3538 - protein, 120 aa, Homo Sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGR

SEQ ID NO: 3539 - protein, 497 aa, Homo Sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 3540 - protein, 449 aa, Homo Sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADVSRMHFQQLSRKAC

SEQ ID NO: 3541 - protein, 496 aa, Homo Sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYRETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 3542 - protein, 43 aa, Homo Sapiens
  misc_feature (1)..(1): Xaa can be any naturally occurring amino acid
XKTAVHAGVISNESGGDVDVMPVDKKKTYVGSLRNGVQSERNM

SEQ ID NO: 3543 - protein, 422 aa, Homo Sapiens
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 3544 - protein, 173 aa, Homo Sapiens
  misc_feature (1)..(1): Xaa can be any naturally occurring amino acid
XQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWKRPGPGGGACEPRGGEPSSGPVRR

SEQ ID NO: 3545 - protein, 102 aa, Homo Sapiens
MEKLLCFLVLTSLSHAFGQTDMSRKAFVFPKESDTSYVSLKAPLTKPLKAFTVCLHFYTELSSTHEINTIYLGGPFSPNVLNWRALKYEVQGEVFTKPQLWP

SEQ ID NO: 3546 - protein, 102 aa, Homo Sapiens; identical to SEQ ID NO: 3545

SEQ ID NO: 3547 - protein, 91 aa, Homo Sapiens
MEKLLCFLVLTSLSHAFGQTDMSRKAFVFPKESDTSYVSLKAPLTKPLKAFTVCLHFYTELSSTRGPNVLNWRALKYEVQGEVFTKPQLWP

SEQ ID NO: 3548 - protein, 224 aa, Homo Sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 3549 - protein, 46 aa, Homo Sapiens
MWDFVLSPDEINTIYLGGPFSPNVLNWRALKYEVQGEVFTKPQLWP

SEQ ID NO: 3550 - protein, 645 aa, Homo Sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 3551 - protein, 661 aa, Homo Sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 3552 - protein, 637 aa, Homo Sapiens
MSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 3553 - protein, 79 aa, Homo Sapiens
  misc_feature (1)..(1): Xaa can be any naturally occurring amino acid
XDEDTLQDPAPLETPMNASSSHSCALETSPYVSTPMEATGAGPTRSAVGATSPTRMAQPAWKEPCYLVSAISLENRMLL

SEQ ID NO: 3554 - protein, 524 aa, Homo Sapiens
YALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 3555 - protein, 401 aa, Homo Sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 3556 - protein, 358 aa, Homo Sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIAVNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 3557 - protein, 593 aa, Homo Sapiens
MAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 3558 - protein, 614 aa, Homo Sapiens
MGGVHVAYRGGAGVAGAVWTVMAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 3559 - protein, 614 aa, Homo Sapiens; identical to SEQ ID NO: 3558

SEQ ID NO: 3560 - protein, 532 aa, Homo Sapiens
MPAPPGRTHTWFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 3561 - protein, 142 aa, Homo Sapiens
IQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPVSLLHPEGSCVSGTWHRQCPSGQG

SEQ ID NO: 3562 - protein, 135 aa, Homo Sapiens
MADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLL

SEQ ID NO: 3563 - protein, 346 aa, Homo Sapiens
MADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 3564 - protein, 129 aa, Homo Sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEE

SEQ ID NO: 3565 - protein, 146 aa, Homo Sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDG

SEQ ID NO: 3566 - protein, 163 aa, Homo Sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLA

SEQ ID NO: 3567 - protein, 493 aa, Homo Sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 3568 - protein, 493 aa, Homo Sapiens; identical to SEQ ID NO: 3567

SEQ ID NO: 3569 - protein, 267 aa, Homo Sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKEVGKRHRPNPGLLILISSHVTTPSRRELRFWDLAPTVSEWSRLMREGKWSPRIWRGRLVWPRLRVLCRSWSVPPLAPLC

SEQ ID NO: 3570 - protein, 267 aa, Homo Sapiens; identical to SEQ ID NO: 3569

SEQ ID NO: 3571 - protein, 45 aa, Homo Sapiens
MADSEALPSLAGDPVAVEALLRAVFGVVVDEAIQKGTSVSQKVHI

SEQ ID NO: 3572 - protein, 520 aa, Homo Sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 3573 - protein, 519 aa, Homo Sapiens
  misc_feature (1)..(1): Xaa can be any naturally occurring amino acid
XLGDARRGAAGYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 3574 - protein, 150 aa, Homo Sapiens
MGWGRLQRISLPSQCLSLLSTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPL

SEQ ID NO: 3575 - protein, 113 aa, Homo Sapiens
MIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFN

SEQ ID NO: 3576 - protein, 285 aa, Homo Sapiens
MTAPGAAGRCPPTIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPS

SEQ ID NO: 3577 - protein, 119 aa, Homo Sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRL

SEQ ID NO: 3578 - protein, 554 aa, Homo Sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 3579 - protein, 554 aa, Homo Sapiens; identical to SEQ ID NO: 3578

SEQ ID NO: 3580 - protein, 438 aa, Homo Sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGHERQSEGSFSPQLQESVFHLLVPSVILVLLAVGGLLFYRWRRRSHQEPQRADSPLEQPEGSPLTQDDRQVELPV

SEQ ID NO: 3581 - protein, 256 aa, Homo Sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSFSPQLQESVFHLLVPSVILVLLAVGGLLFYRWRRRSHQEPQRADSPLEQPEGSPLTQDDRQVELPV

SEQ ID NO: 3582 - protein, 64 aa, Homo Sapiens
AGSPWALGQRPFGAQGLKGPVCVAATAHADEKEALMSELKIMSHLGQHENIVNLLGACTHGGIS

SEQ ID NO: 3583 - protein, 972 aa, Homo Sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 3584 - protein, 671 aa, Homo Sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGTVASPARVWTPMWR

SEQ ID NO: 3585 - protein, 306 aa, Homo Sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVGTPSPSLCPA

SEQ ID NO: 3586 - protein, 49 aa, Homo Sapiens
MRHTNYSFSPWHGFTIHRAKFIQSQDYQCSALMGGRKVMSISIRLKVQK

SEQ ID NO: 3587 - protein, 144 aa, Homo Sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 3588 - protein, 238 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWK

SEQ ID NO: 3589 - protein, 377 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFDHLGGIHPRGRERLPRRGLDREGNYLRPRGCRNGMDISASATRGNCFLDDAVNLYIIFYVFI

SEQ ID NO: 3590 - protein, 410 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEMGPQRHHRCGWNLYPTPGPSPGSGSSPRLGSESSL

SEQ ID NO: 3591 - protein, 333 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSLGYSGCSRQFHRSKTN

SEQ ID NO: 3592 - protein, 400 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 3593 - protein, 400 aa, Homo Sapiens; identical to SEQ ID NO: 3592

SEQ ID NO: 3594 - protein, 434 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSHSVTQAGVQWHNLGSLQPPSPRLKRFSCLRLPGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 3595 - protein, 285 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLVLTTGTSALCTFMCS

SEQ ID NO: 3596 - protein, 400 aa, Homo Sapiens; identical to SEQ ID NO: 3592

SEQ ID NO: 3597 - protein, 233 aa, Homo Sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIGSLGYSGCSRQFHRSKTN

SEQ ID NO: 3598 - protein, 90 aa, Homo Sapiens
MLLLVTSLLLCELPHPAFLLIPEKSDLRTVAPASSLNVRFDSRTMNLSWDCQENTTFSKCFLTDKKNRVVEPRMEFPSCCPDRTIAHQPA

SEQ ID NO: 3599 - protein, 267 aa, Homo Sapiens
MNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 3600 - protein, 155 aa, Homo Sapiens
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFL

SEQ ID NO: 3601 - protein, 204 aa, Homo Sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3602 - protein, 171 aa, Homo Sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3603 - protein, 207 aa, Homo Sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3604 - protein, 57 aa, Homo Sapiens
MAGPATQSPMKLMVCHLQAVPPRGAGAARTLSGHPLGSPEQLPQPGPAAGRLLEPTP

SEQ ID NO: 3605 - protein, 164 aa, Homo Sapiens
MSPEPALSPALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3606 - protein, 200 aa, Homo Sapiens
MSPEPALSPALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3607 - protein, 14 aa, Homo Sapiens
MMMVRRGLLAWISR

SEQ ID NO: 3608 - protein, 53 aa, Homo Sapiens
MMMVRRGLLAWISRVVVLLVLLCCAISVLYMLACTPKGDEEQLALPRANSPTG

SEQ ID NO: 3609 - protein, 96 aa, Homo Sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNG

SEQ ID NO: 3610 - protein, 104 aa, Homo Sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAA

SEQ ID NO: 3611 - protein, 532 aa, Homo Sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 3612 - protein, 297 aa, Homo Sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFRPADEVFRCVPLSP

SEQ ID NO: 3613 - protein, 297 aa, Homo Sapiens; identical to SEQ ID NO: 3612

SEQ ID NO: 3614 - protein, 532 aa, Homo Sapiens; identical to SEQ ID NO: 3611

SEQ ID NO: 3615 - protein, 532 aa, Homo Sapiens; identical to SEQ ID NO: 3611

SEQ ID NO: 3616 - protein, 217 aa, Homo Sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 3617 - protein, 256 aa, Homo Sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 3618 - protein, 122 aa, Homo Sapiens
MAPGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 3619 - protein, 128 aa, Homo Sapiens
MEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 3620 - protein, 160 aa, Homo Sapiens
MAAGSRTSLLLAFALLCLPWLQEADSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 3621 - protein, 217 aa, Homo Sapiens
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 3622 - protein, 167 aa, Homo Sapiens
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVANPGTPLA

SEQ ID NO: 3623 - protein, 122 aa, Homo Sapiens
MAAGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 3624 - protein, 128 aa, Homo Sapiens; identical to SEQ ID NO: 3619

SEQ ID NO: 3625 - protein, 139 aa, Homo Sapiens
MAADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 3626 - protein, 178 aa, Homo Sapiens
MAADSIPTSSNMEETQQKSNLELLHISLLLIESRLEPVRFLRSTFTNNLVYDTSDSDDYHLLKDLEEGIQMLMGVRVAPGVPNPGSPLASRAGGEKHCCPLFSSQALTQENSPYSSFPLVNPPGLSLHPEGEGGKWINERGREQCPSAWSLLLLLHFAEAGRRQPPDWADPQADLQQV

SEQ ID NO: 3627 - protein, 160 aa, Homo Sapiens
MAAGSRTSLLLAFALLCLPWLQEADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 3628 - protein, 222 aa, Homo Sapiens
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 3629 - protein, 217 aa, Homo Sapiens [sequence omitted]

SEQ ID NO: 3630 - protein, 128 aa, Homo Sapiens
MEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 3631 - protein, 167 aa, Homo Sapiens
MEETQQKSNLELLHISLLLIESRLEPVRFLRSTFTNNLVYDTSDSDDYHLLKDLEEGIQMLMGVRVAPGVPNPGSPLASRAGGEKHCCPLFSSQALTQENSPYSSFPLVNPPGLSLHPEGEGGKWINERGREQCPSAWSLLLLLHFAEAGRRQPPDWADPQADLQQV

SEQ ID NO: 3632 - protein, 76 aa, Homo Sapiens
KMESSISSSSEEQIRRMNENSHVQVPFQQLNQLAAYPYAVWYYPQIMQYVPFPPFSDISNPTAHENYEKNNVMLQW

SEQ ID NO: 3633 - protein, 185 aa, Homo Sapiens
MRLLILTCLVAVALARPKLPLRYPERLQNPSESSEPIPLESREEYMNGMNRQRNILREKQTDEIKDTRNESTQNCVVAEPEKMESSISSSSEEMSLSKCAEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3634 - protein, 177 aa, Homo Sapiens
MRLLILTCLVAVALARPKLPLRYPERLQNPSESSEPIPLESREEYMNGMNRQRNILREKQTDEIKDTRNESTQNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3635 - protein, 169 aa, Homo Sapiens
MRLLILTCLVAVALARPKLPLRYPERLQNPSESSEPIPLESREEYMNGMNRQRNILREKQTDEIKNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3636 - protein, 176 aa, Homo Sapiens
MRLLILTCLVAVALARPKLPLRYPERLQNPSESSEPIPLESREEYMNGMNRRNILREKQTDEIKDTRNESTQNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3637 - protein, 55 aa, Homo Sapiens
QRNILREKQTDEIKNCVVAEPEKMESSISSSSEEMSLSKCAEQFCRLNEYNQLQL

SEQ ID NO: 3638 - protein, 226 aa, Homo Sapiens
MKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 3639 - protein, 182 aa, Homo Sapiens
MKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 3640 - protein, 141 aa, Homo Sapiens
MAQYLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 3641 - protein, 141 aa, Homo Sapiens; identical to SEQ ID NO: 3640

SEQ ID NO: 3642 - protein, 103 aa, Homo Sapiens
MMAEPWQALQLLLAILLTLMALPYQARKKTFLSVHEVMAVENYAKDSLQWITDQYNKESDDKYHFRIFRVLKVQRQQVNCFFSVFAVPWFEQYKILNKSCSSD

SEQ ID NO: 3643 - protein, 138 aa, Homo Sapiens
MMAEPWQALQLLLAILLTLMALPYQARKKTFLSVHEVMAVENYAKDSLQWITDQYNKESDDKYHFRIFRVLKVQRQVTDHLEYHLNVEMQWTTCQKPETTNCVPQERELHKQVNCFFSVFAVPWFEQYKILNKSCSSD

SEQ ID NO: 3644 - protein, 141 aa, Homo Sapiens
MAWPLCTLLLLLATQAVALAWSPQEEDRIIEGGIYDADLNDERVQRALHFVISEYNKATEDEYYRRLLRVLRAREQIVGGVNYFFDIEVGRTICTKSQPNLDTCAFHEQPELQKKQLCSFQIYEVPWEDRMSLVNSRCQEA

SEQ ID NO: 3645 - protein, 146 aa, Homo Sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 3646 - protein, 146 aa, Homo Sapiens; identical to SEQ ID NO: 3645

SEQ ID NO: 3647 - protein, 146 aa, Homo Sapiens; identical to SEQ ID NO: 3645

SEQ ID NO: 3648 - protein, 141 aa, Homo Sapiens
MARPLCTLLLLMATLAGALASSSKEENRIIPGGIYDADLNDEWVQRALHFAISEYNKATEDEYYRRPLQVLRAREQTFGGVNYFFDVEVGRTICTKSQPNLDTCAFHEQPELQKKQLCSFEIYEVPWEDRMSLVNSRCQEA

SEQ ID NO: 3649 - protein, 142 aa, Homo Sapiens
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 3650 - protein, 149 aa, Homo Sapiens
MARSNLPLALGLALVAFCLLALPRDARARPQERMVGELRDLSPDDPQVQKAAQAAVASYNMGSNSIYYFRDTHIIKAQSQLVAGIKYFLTMEMGSTDCRKTRVTGDHVDLTTCPLAAGAQQEKLRCDFEVLVVPWQNSSQLLKHNCVQM

SEQ ID NO: 3651 - protein, 145 aa, Homo Sapiens
MRAAGTLLAFCCLVLSTTGGPSPDTCSQDLNSRVKPGFPKTIKTNDPGVLQAARYSVEKFNNCTNDMFLFKESRITRALVQIVKGLKYMLEVEIGRTTCKKNQHLRLDDCDFQTNHTLKQTLSCYSEVWVVPWLQHFEVPVLRCH

SEQ ID NO: 3652 - protein, 134 aa, Homo Sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTV

SEQ ID NO: 3653 - protein, 142 aa, Homo Sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 3654 - protein, 159 aa, Homo Sapiens
MSSPQRRKAMPWALSLLLMGFQLLVTYAWCSEEEMGGNNKIVQDPMFLATVEFALNTFNVQSKEEHAYRLLRVLSSWREDSMDRKWRGKMVFSMNLQLRQTVCRKFEDDIDNCPFQESLELNNVRQGISFPQVHSCGCCMGCGVGTGAADKAIPRDKGK

SEQ ID NO: 3655 - protein, 147 aa, Homo Sapiens
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 3656 - protein, 145 aa, Homo Sapiens
MGIGCWRNPLLLLIALVLSAKLGHFQRWEGFQQKLMSKKNMNSTLNFFIQSYNNASNDTYLYRVQRLIRSQMQLTTGVEYIVTVKIGWTKCKRNDTSNSSCPLQSKKLRKSLICESLIYTMPWINYFQLWNNSCLEAEHVGRNLR

SEQ ID NO: 3657 - protein, 145 aa, Homo Sapiens; identical to SEQ ID NO: 3656

SEQ ID NO: 3658 - protein, 37 aa, Homo Sapiens
MNSTLNFFIQSYNNASNDTYLYRVQRLIRSQMQQVHC

SEQ ID NO: 3659 - protein, 242 aa, Homo Sapiens
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKS

SEQ ID NO: 3660 - protein, 264 aa, Homo Sapiens
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 3661 - protein, 385 aa, Homo Sapiens
MSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 3662 - protein, 77 aa, Homo Sapiens
MSRPQLRRWRLVSSPPSGVPGLALLALLALLALRLAAGTDCPCPEPELCRPIRHHPDFEVSAFLCSSRSGLQGTKRS

SEQ ID NO: 3663 - protein, 77 aa, Homo Sapiens; identical to SEQ ID NO: 3662

SEQ ID NO: 3664 - protein, 349 aa, Homo Sapiens
MTAASMGPVRVAFVVLLALCSRPAVGQNCSGPCRCPDEPAPRCPAGVSLVLDGCGCCRVCAKQLGELCTERDPCDPHKGLFCHFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 3665 - protein, 243 aa, Homo Sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 3666 - protein, 147 aa, Homo Sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAVSLNYFKIEARFKGFHILVLIFR

SEQ ID NO: 3667 - protein, 113 aa, Homo Sapiens
MRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 3668 - protein, 229 aa, Homo Sapiens
MWPPGRSITVKLREKTVSRKLEMNGPSAFQGLICGKYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 3669 - protein, 174 aa, Homo Sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 3670 - protein, 223 aa, Homo Sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 3671 - protein, 79 aa, Homo Sapiens
MACLGFQRHKAQLNLATRTWPCTLLFFLLFIPVFCKAMHVAQPAVVLASSRGIASFVSKEKKPSYNRGLCENAPNRARM

SEQ ID NO: 3672 - protein, 137 aa, Homo Sapiens
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 3673 - protein, 53 aa, Homo Sapiens
MIRNWLTIFILFPLKLVEKCESSVSLTVPPVVKLENGSSTNVSLTLRLWCLLE

SEQ ID NO: 3674 - protein, 75 aa, Homo Sapiens
MIRNWLTIFILFPLKLVEKCESSVSLTVPPVVKLENGSSTNVSLTLRPPLNATLVITFEITFRSKNITILELPDE

SEQ ID NO: 3675 - protein, 122 aa, Homo Sapiens
MIRNWLTIFILFPLKLVEKCESSVSLTVPPVVKLENGSSTNVSLTLRPPLNATLVITFEITFRSKNITILELPDELVEAGGEECRDEISSHEAHQDGLQISSEPPRKQTGVKHDQSPACGNL

SEQ ID NO: 3676 - protein, 163 aa, Homo Sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFV

SEQ ID NO: 3677 - protein, 367 aa, Homo Sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 3678 - protein, 400 aa, Homo Sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGLQAARTGSGSRLRQDWAPSLQPKALPQTTSVSASSLKG

SEQ ID NO: 3679 - protein, 20 aa, Homo Sapiens
MNWRRKSVIGLSFDFVALNL

SEQ ID NO: 3680 - protein, 28 aa, Homo Sapiens
MNWRRKSVIGLSFDFVALNLTGFVAYSV

SEQ ID NO: 3681 - protein, 263 aa, Homo Sapiens
MASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 3682 - protein, 182 aa, Homo Sapiens
MCQGGPELASVDWGRTGRAARRQVRPRWVWGLSPYSPHSPPGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTG

SEQ ID NO: 3683 - protein, 16 aa, Homo Sapiens
  misc_feature (1)..(1): Xaa can be any naturally occurring amino acid
XVTKLIPWVQKILAAN

SEQ ID NO: 3684 - protein, 114 aa, Homo Sapiens
DKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNG

SEQ ID NO: 3685 - protein, 168 aa, Homo Sapiens
EFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGGDSGGPLVCQKDGAWTLVGIVSWGSRTCSTTTPAVYARVAKLIPWVQKILAAN

SEQ ID NO: 3686 - protein, 263 aa, Homo Sapiens
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVAKLIPWVQKILAAN

SEQ ID NO: 3687 - protein, 137 aa, Homo Sapiens
VAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMVRLALPRPWPG

SEQ ID NO: 3688 - protein, 268 aa, Homo Sapiens [sequence omitted]

SEQ ID NO: 3689 - protein, 69 aa, Homo Sapiens
MLGITVLAALLACATPGPTVWPWERTTWRWKTKKDPCLWVWTPSTSTRDGMPSCCAMILPSSSLQSMWS

SEQ ID NO: 3690 - protein, 190 aa, Homo Sapiens
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALLSARRETHGCLLVLSPGAPKTAMCAHLLCILELASSAPGST

SEQ ID NO: 3691 - protein, 264 aa, Homo Sapiens
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 3692 - protein, 190 aa, Homo Sapiens
MLLLSLTLSLVLLGSSWGQQRLPLLRWFSHQPVLGGHCCPLQCQVLSVSRVSAWAADTEEKWAVQAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGI

SEQ ID NO: 3693 - protein, 110 aa, Homo Sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTL

SEQ ID NO: 3694 - protein, 480 aa, Homo Sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 3695 - protein, 480 aa, Homo Sapiens; identical to SEQ ID NO: 3694

SEQ ID NO: 3696 - protein, 480 aa, Homo Sapiens; identical to SEQ ID NO: 3694

SEQ ID NO: 3697 - protein, 82 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHY

SEQ ID NO: 3698 - protein, 481 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 3699 - protein, 498 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 3700 - protein, 231 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQVQGAGCGQWTLLL

SEQ ID NO: 3701 - protein, 202 aa, Homo Sapiens
QDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRTLLWSRIWATSSLACHSSGCGIRHCCAQGIKCAWTPPAPTQQLLPPTSTTRTCGRPSTSRSSCHNGTCA

SEQ ID NO: 3702 - protein, 21 aa, Homo Sapiens
MWQLWASLCCLLVLANARSRP

SEQ ID NO: 3703 - protein, 32 aa, Homo Sapiens
MWQLWASLCCLLVLANARSRPSFHPLSDELVN

SEQ ID NO: 3704 - protein, 55 aa, Homo Sapiens
MWQLWASLCCLLVLANARSRPSFHPLSDELVNYVNKRNTTWQAGHNFYNVDMSYL

SEQ ID NO: 3705 - protein, 68 aa, Homo Sapiens
MWQLWASLCCLLVLANARSRPSFHPLSDELVNYVNKRNTTWQAGHNFYNVDMSYLKRLCGTFLGGPKP

SEQ ID NO: 3706 - protein, 70 aa, Homo Sapiens
MWQLWASLCCLLVLANARSRPSFHPLSDELVNYVNKRNTTWQAGHNFYNVDMSYLKRLCGTFLGGPKPPQ

SEQ ID NO: 3707 - protein, 70 aa, Homo Sapiens; identical to SEQ ID NO: 3706

SEQ ID NO: 3708 - protein, 92 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQ

SEQ ID NO: 3709 - protein, 98 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKE

SEQ ID NO: 3710 - protein, 101 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRD

SEQ ID NO: 3711 - protein, 136 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAE

SEQ ID NO: 3712 - protein, 143 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCG

SEQ ID NO: 3713 - protein, 143 aa, Homo Sapiens; identical to SEQ ID NO: 3712

SEQ ID NO: 3714 - protein, 149 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDG

SEQ ID NO: 3715 - protein, 165 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRK

SEQ ID NO: 3716 - protein, 170 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSG

SEQ ID NO: 3717 - protein, 175 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYES

SEQ ID NO: 3718 - protein, 339 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 3719 - protein, 339 aa, Homo Sapiens; identical to SEQ ID NO: 3718

SEQ ID NO: 3720 - protein, 339 aa, Homo Sapiens; identical to SEQ ID NO: 3718

SEQ ID NO: 3721 - protein, 339 aa, Homo Sapiens; identical to SEQ ID NO: 3718

SEQ ID NO: 3722 - protein, 339 aa, Homo Sapiens; identical to SEQ ID NO: 3718

SEQ ID NO: 3723 - protein, 339 aa, Homo Sapiens; identical to SEQ ID NO: 3718

SEQ ID NO: 3724 - protein, 339 aa, Homo Sapiens; identical to SEQ ID NO: 3718

SEQ ID NO: 3725 - protein, 110 aa, Homo Sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWL

SEQ ID NO: 3726 - protein, 76 aa, Homo Sapiens
SGVYQHVTGEMMGGHAIRILGWGVENGTPYWLVANSWNTDWGDNGFFKILRGQDHCGIESEVVAGIPRTDQYWEKI

SEQ ID NO: 3727 - protein, 141 aa, Homo Sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLAMNRRWG

SEQ ID NO: 3728 - protein, 137 aa, Homo Sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLVIK

SEQ ID NO: 3729 - protein, 463 aa, Homo Sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 3730 - protein, 36 aa, Homo Sapiens
  misc_feature (1)..(1): Xaa can be any naturally occurring amino acid
XDVTDFISHLFMQLGTVGIYDLPHLRNKLAMNRRWG

SEQ ID NO: 3731 - protein, 245 aa, Homo Sapiens
  misc_feature (1)..(1): Xaa can be any naturally occurring amino acid
XVVDSPLARSARLPGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEV

SEQ ID NO: 3732 - protein, 299 aa, Homo Sapiens
MPRPVVDRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKA

SEQ ID NO: 3733 - protein, 405 aa, Homo Sapiens
MQPSSLLPLALCLLAAPASALVRIPLHKFTSIRRTMSEVGGSVEDLIAKGPVSKYSQAVPAVTEGPIPEAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3734 - protein, 412 aa, Homo Sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3735 - protein, 276 aa, Homo Sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQ

SEQ ID NO: 3736 - protein, 406 aa, Homo Sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3737 - protein, 405 aa, Homo Sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3738 - protein, 409 aa, Homo Sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKAGKTLCLSGFMGMDIPPPSGPLWILGDVFIGRYYTVFDRDNNRVGFAEAARL

SEQ ID NO: 3739 - protein, 410 aa, Homo Sapiens
MQPSSLLPLALCLLAAPASALVRIPLHKFTSIRRTMSEVGGSVEDLIAKGPVSKYSQAVPAVTEGPIPEVLKNYMDYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3740 - protein, 94 aa, Homo Sapiens
MSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSS

SEQ ID NO: 3741 - protein, 199 aa, Homo Sapiens
MSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLS

SEQ ID NO: 3742 - protein, 189 aa, Homo Sapiens
NVTRKAYWQVHLDQSPEGRRVQPSQGRGSQGGALGPQGTLQSRQGLHALTPRRVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 3743 - protein, 396 aa, Homo Sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 3744 - protein, 363 aa, Homo Sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 3745 - protein, 484 aa, Homo Sapiens [sequence omitted]

SEQ ID NO: 3746 - protein, 120 aa, Homo Sapiens
MVCRLPVSKKTLLCSFQVLDELGRHVLLRKDCGPVDTKVPGAGEPKSAFTQGSAMISSLSQNHPDNRNETFSSVISLLNEDPLSQDLPVKMASIFKNFVITYNRTYESKEEARWRLSVFV

SEQ ID NO: 3747 - protein, 283 aa, Homo Sapiens
  misc_feature (1)..(1): Xaa can be any naturally occurring amino acid
XQNHPDNRNETFSSVISLLNEDPLSQDLPVKMASIFKNFVITYNRTYESKEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLL

SEQ ID NO: 3748 - protein, 82 aa, Homo Sapiens
  misc_feature (1)..(1): Xaa can be any naturally occurring amino acid
XRTIYLNTLLRKEPGNKMKQAKSVGDLAPPEWDWRSKGAVTKVKDQGMCGSCWAFSVTGNVEGQWFLNQGTLLSLSEQALGL

SEQ ID NO: 3749 - protein, 255 aa, Homo Sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 3750 - protein, 134 aa, Homo Sapiens
MALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGK

SEQ ID NO: 3751 - protein, 323 aa, Homo Sapiens
MWATLPLLCAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 3752 - protein, 335 aa, Homo Sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 3753 - protein, 62 aa, Homo Sapiens
MWATLPLLCAGAWLLGVPVCGAAELCVNSLEKFHFKSWMSKKTKAHCVLVAESVGEHQCMCF

SEQ ID NO: 3754 - protein, 41 aa, Homo Sapiens
MWATLPLLCAGAWLLGVPVCGAAELCVNSLGTQRARRPRGC

SEQ ID NO: 3755 - protein, 118 aa, Homo Sapiens
MWATLPLLCAGAWLLGVPVCGAAELCVNSLVAGLSPPLGPWSLRSPSQPERCCPWRNSSWWTAPRTSIITAAKGVSPARLSSISCTTRGSWVKTPTPTRARMVIASSNLERPSALSRM

SEQ ID NO: 3756 - protein, 258 aa, Homo Sapiens
MHKENEEIYNVSENRKHCPIFPCPLLTRSGKVPEFRHEREERLEEMIRRQNLDGNLSFVMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSED

SEQ ID NO: 3757 - protein, 329 aa, Homo Sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 3758 - protein, 333 aa, Homo Sapiens [sequence omitted]

SEQ ID NO: 3759 - protein, 333 aa, Homo Sapiens [sequence omitted]

SEQ ID NO: 3760 - protein, 225 aa, Homo Sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTL

SEQ ID NO: 3761 - protein, 321 aa, Homo Sapiens
MDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 3762 - protein, 117 aa, Homo Sapiens
IIDNKGIDSDASYPYKAMDQKCQYDSKYRAATCSKYTELPYGREDVLKEAVANKGPVSVGVDARHPSFFLYRSDGVLLCCQAGVRWHDLSSLQPLPPGFKQFSCLSLLSSWDYRCLL

SEQ ID NO: 3763 - protein, 281 aa, Homo Sapiens
MKRLVCVLLVCSSAVAQLHKDPTLDHHWHLWKKTYGKQYKEKNEEAVRRLIWEKNLKFVMLHNLEHSMGMHSYDLGMNHLGDMGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 3764 - protein, 331 aa, Homo Sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 3765 - protein, 96 aa, Homo Sapiens
  misc_feature (1)..(1): Xaa can be any naturally occurring amino acid
XVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 3766 - protein, 5 aa, Homo Sapiens
  misc_feature (1)..(1): Xaa can be any naturally occurring amino acid
XYPEI

SEQ ID NO: 3767 - protein, 334 aa, Homo Sapiens
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 3768 - protein, 334 aa, Homo Sapiens; identical to SEQ ID NO: 3767

SEQ ID NO: 3769 - protein, 211 aa, Homo Sapiens
ALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQGGLASEKDYPFQGKVRAHRCHPKKYQKVAWIQD

SEQ ID NO: 3770 - protein, 376 aa, Homo Sapiens
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 3771 - protein, 364 aa, Homo Sapiens
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKVSVIYWGRGQGRTGLFPPSRPYVP

SEQ ID NO: 3772 - protein, 303 aa, Homo Sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 3773 - protein, 3623 aa, Homo Sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 3774 - protein, 170 aa, Homo Sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKVSHLLFG

SEQ ID NO: 3775 - protein, 105 aa, Homo Sapiens
NSKLVDLERKFQGLQQTVDKKVCSSNPCQNGGTCLNLHDSFFCICPPQWKGPLCSADVNECEIYSGTPLSCQNGGTCVNTMGSYRNPCSNIPKEPEEGSRDWHRE

SEQ ID NO: 3776 - protein, 88 aa, Homo Sapiens
STGNELAIRFKTDLSINGRGFNASWQAVTGGCGGIFQAPSGEIHSPNYPSPYRSNTDCSWVIRVDRNHRVLLNFTDFDLEPQDSCIMV

SEQ ID NO: 3777 - protein, 198 aa, Homo Sapiens
MIGSGLAGSGGAGGPSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 3778 - protein, 135 aa, Homo Sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAESCHDEPCSCSS

SEQ ID NO: 3779 - protein, 156 aa, Homo Sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 3780 - protein, 156 aa, Homo Sapiens; identical to SEQ ID NO: 3779

SEQ ID NO: 3781 - protein, 156 aa, Homo Sapiens; identical to SEQ ID NO: 3779

SEQ ID NO: 3782 - protein, 156 aa, Homo Sapiens; identical to SEQ ID NO: 3779

SEQ ID NO: 3783 - protein, 155 aa, Homo Sapiens
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMFCAPLRSGRGNCIACGTGELSVPAVGAPGHRVSF

SEQ ID NO: 3784 - protein, 179 aa, Homo Sapiens
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 3785 - protein, 42 aa, Homo Sapiens
MSGGRAPAVLLGGVVSDRPRPAPSGPRSLDRYPHPKSQRLAP

SEQ ID NO: 3786 - protein, 111 aa, Homo Sapiens
  misc_feature (1)..(1): Xaa can be any naturally occurring amino acid
XSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSM

SEQ ID NO: 3787 - protein, 55 aa, Homo Sapiens
MAPISLSWLLRLATFCHLTVLLAAWRRDSTGCSVPTRRSNGSRTRCSIWTARLLP

SEQ ID NO: 3788 - protein, 397 aa, Homo Sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 3789 - protein, 403 aa, Homo Sapiens
MAPISLSWLLRLATFCHLTVLLAGTSLNSGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 3790 - protein, 359 aa, Homo Sapiens
MTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 3791 - protein, 89 aa, Homo Sapiens
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 3792 - protein, 200 aa, Homo Sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 3793 - protein, 365 aa, Homo Sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 3794 - protein, 352 aa, Homo Sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 3795 - protein, 252 aa, Homo Sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 3796 - protein, 107 aa, Homo Sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 3797 - protein, 98 aa, Homo Sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 3798 - protein, 94 aa, Homo Sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 3799 - protein, 94 aa, Homo Sapiens; identical to SEQ ID NO: 3798

SEQ ID NO: 3800 - protein, 89 aa, Homo Sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 3801 - protein, 119 aa, Homo Sapiens
MNAKVVVVLVLVLTALCLSDGKPVSLSYRCPCRFFESHVARANVKHLKILNTPNCALQIVARLKNNNRQVCIDPKLKWIQEYLEKALNKGRREEKVGKKEKIGKKKRQKKRKAAQKRKN

SEQ ID NO: 3802 - protein, 93 aa, Homo Sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 3803 - protein, 140 aa, Homo Sapiens
MNAKVVVVLVLVLTALCLSDGKPVSLSYRCPCRFFESHVARANVKHLKILNTPNCALQIVARLKNNNRQVCIDPKLKWIQEYLEKALNNLISAAPAGKRVIAGARALHPSPPRACPTARALCEIRLWPPPEWSWPSPGDV

SEQ ID NO: 3804 - protein, 103 aa, Homo Sapiens
MNAKVVVVLVLVLTALCLSDGKPVSLSYRCPCRFFESHYCTCLIRVSFHGATPLTQGSWVLYSLSCAGGETGLREPGPMVSPRVESHQEGRLGVPGPVNLGKA

SEQ ID NO: 3805 - protein, 103 aa, Homo Sapiens; identical to SEQ ID NO: 3804

SEQ ID NO: 3806 - protein, 109 aa, Homo Sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 3807 - protein, 99 aa, Homo Sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 3808 - protein, 111 aa, Homo Sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 3809 - protein, 62 aa, Homo Sapiens
MKVLISSLLLLLPLMLMSMVSSSLNPGVARGHRDRGQASRRWLQEGGQECECKAMLLFQIGS

SEQ ID NO: 3810 - protein, 119 aa, Homo Sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 3811 - protein, 107 aa, Homo Sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 3812 - protein, 107 aa, Homo Sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 3813 - protein, 114 aa, Homo Sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 3814 - protein, 113 aa, Homo Sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDRYLSL

SEQ ID NO: 3815 - protein, 114 aa, Homo Sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 3816 - protein, 95 aa, Homo Sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKR

SEQ ID NO: 3817 - protein, 99 aa, Homo Sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 3818 - protein, 125 aa, Homo Sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 3819 - protein, 182 aa, Homo Sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 3820 - protein, 433 aa, Homo Sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDRDKLRLLYTLAVNSHPILLQIFPGAEGWPLPKYLGSCGRFLVSTSTRPLQEFYDAPPDQAADLAYQLLGVLESLRSNDLNYFFYFTHIDAGMFGVFNNGHLFIRDASAVGVIDKQEGSQEANRAGENKDIFSCLVSGCQAQLPSCESISEKQSLVLVCQKLLPRLLQGRFPSPVQDDIDSILVQCGDSIRPDPEVLGAASQLKDILRPLRTCDSRFAYRYPDCKYNDKF

SEQ ID NO: 3821 - protein, 264 aa, Homo Sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 3822 - protein, 106 aa, Homo Sapiens
MLTLHNWLSFYEKNYVCVGRVTGRFYGEDGLPTPALTQVEAAITRGLEANKLQLQEKQTFPPCNAEWSSARGSRLWCSQKRGFNSSLALASGSLKHACHRLILQFL

SEQ ID NO: 3823 - protein, 152 aa, Homo Sapiens
MLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 3824 - protein, 152 aa, Homo Sapiens; identical to SEQ ID NO: 3823

SEQ ID NO: 3825 - protein, 42 aa, Homo Sapiens
MAPKPGAEWSTALSHLVLGVVSLHAAVSTAEASRGAAAGFLL

SEQ ID NO: 3826 - protein, 362 aa, Homo Sapiens
MAPKPGAEWSTALSHLVLGVVSLHAAVSTAEASRGAAAGFLLQVLAATTTLAPGLSTHEDCLAGAWVATVIGLPLLAFDFHWCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 3827 - protein, 144 aa, Homo Sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGA

SEQ ID NO: 3828 - protein, 192 aa, Homo Sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 3829 - protein, 192 aa, Homo Sapiens; identical to SEQ ID NO: 3828

SEQ ID NO: 3830 - protein, 192 aa, Homo Sapiens; identical to SEQ ID NO: 3828

SEQ ID NO: 3831 - protein, 246 aa, Homo Sapiens
MAPKPGAEWSTALSHLVLGVVSLHAAVSTAECTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPL

SEQ ID NO: 3832 - protein, 404 aa, Homo Sapiens
MSGAEEAGGGGPAAGPAGSVPAGVGVGVGAGPGAAAGQAAAAALGEAAGPGLPDEAGLAGARQLQLQEAAGDPDAPPKKRLRAAEAAEAAAAAAAAGSGKLEERLYSVLCCTVCLDLPKASVYQCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 3833 - protein, 479 aa, Homo Sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 3834 - protein, 508 aa, Homo Sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 3835 - protein, 509 aa, Homo Sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 3836 - protein, 407 aa, Homo Sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 3837 - protein, 356 aa, Homo Sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 3838 - protein, 192 aa, Homo Sapiens
MIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 3839 - protein, 258 aa, Homo Sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTILEDSMIFSLASCIITAKLCTWAICFLTTSEEVQKKLYEEINQVFGNGPVTPEKIEQL

SEQ ID NO: 3840 - protein, 470 aa, Homo Sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTLCIFTYFQVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 3841 - protein, 208 aa, Homo Sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTPSCNWSLF

SEQ ID NO: 3842 - protein, 462 aa, Homo Sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 3843 - protein, 44 aa, Homo Sapiens
MLDFAIFAVTFLLALVGAVLYLYPASRQAAGIPGITPTEENGPF

SEQ ID NO: 3844 - protein, 44 aa, Homo Sapiens; identical to SEQ ID NO: 3843

SEQ ID NO: 3845 - protein, 78 aa, Homo Sapiens
MLLLGLLLLLPLLAGARLLWNWWKLRSLHLPPLAPGFLHLLQPDLPIYLLGLTQKFGPIYRLHLGLQAPTSSCRQAGV

SEQ ID NO: 3846 - protein, 465 aa, Homo Sapiens
MLLLGLLLLLPLLAGARLLWNWWKLRSLHLPPLAPGFLHLLQPDLPIYLLGLTQKFGPIYRLHLGLQDKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 3847 - protein, 186 aa, Homo Sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTFPTLQPPPPPADKLVSRNYPDLSLGDYSLLWKAHKKLTRSALLLGIRDSMEPVVEQLTQEFCERMRAQPGTPVAIEEEFSLLTCSIICY

SEQ ID NO: 3848 - protein, 108 aa, Homo Sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTSPTSSCRQAGV

SEQ ID NO: 3849 - protein, 495 aa, Homo Sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 3850 - protein, 495 aa, Homo Sapiens; identical to SEQ ID NO: 3849

SEQ ID NO: 3851 - protein, 495 aa, Homo Sapiens; identical to SEQ ID NO: 3849

SEQ ID NO: 3852 - protein, 190 aa, Homo Sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKEVLKTWS

SEQ ID NO: 3853 - protein, 321 aa, Homo Sapiens
MAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 3854 - protein, 172 aa, Homo Sapiens
MKNKTCVLVCVSVFGGERGQVTVPRVGVRRPSLAGPLQKCTLRETRVWLPQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLT

SEQ ID NO: 3855 - protein, 512 aa, Homo Sapiens
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 3856 - protein, 182 aa, Homo Sapiens
MLFEGLDLVSALATLAACLVSVTLLLAVSQQLWQLRWAATRDKSCKLPIPKGSMGFPLIGETGHWLLQVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQC

SEQ ID NO: 3857 - protein, 437 aa, Homo Sapiens
MLFEGLDLVSALATLAACLVSVTLLLAVSQQLWQLRWAATRDKSCKLPIPKGSMGFPLIGETGHWLLQVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 3858 - protein, 494 aa, Homo Sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVYPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 3859 - protein, 65 aa, Homo Sapiens
MLASGMLLVALLVCLTVMVLMSVWQQRKSKGKLPPGPTPLPFIGNYLQLNTEQMYNSLMKVSQDQ

SEQ ID NO: 3860 - protein, 80 aa, Homo Sapiens
MLASGLLLVALLACLTVMVLMSVWQQRKSRGKLPPGPTPLPFIGNYLQLNTEHICDSIMKAWRSATGSAPSSSCALPSPP

SEQ ID NO: 3861 - protein, 494 aa, Homo Sapiens
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 3862 - protein, 443 aa, Homo Sapiens
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 3863 - protein, 491 aa, Homo Sapiens
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 3864 - protein, 491 aa, Homo Sapiens; identical to SEQ ID NO: 3863

SEQ ID NO: 3865 - protein, 255 aa, Homo Sapiens
MLCGVEAIREALVDKAEAFSGRGKIAMVDPFFRGYGVIFANGNRWKVLRRFSVTTMRDFGMGKRSVEERIQEEAQCLIEELRKSKERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 3866 - protein, 194 aa, Homo Sapiens
  misc_feature (1)..(1): Xaa can be any naturally occurring amino acid
XPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQTESRCFIPAGV

SEQ ID NO: 3867 - protein, 431 aa, Homo Sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 3868 - protein, 490 aa, Homo Sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 3869 - protein, 490 aa, Homo Sapiens
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVIGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 3870 - protein, 162 aa, Homo Sapiens
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKGG

SEQ ID NO: 3871 - protein, 307 aa, Homo Sapiens
MAAKCCSTFFLGCEFSQFLPLFLLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 3872 - protein, 490 aa, Homo Sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 3873 - protein, 393 aa, Homo Sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 3874 - protein, 99 aa, Homo Sapiens
MEPFVVLVLCLSFMLLFSLWRQSCRRRKLPPGPTPLPIIGNMLQIDVKDICKSFTNVSLPYVPPANCKGNHFQQWKEMEGDPAFLPHNLAEFWDGEEEH

SEQ ID NO: 3875 - protein, 83 aa, Homo Sapiens
MEPFVVLVLCLSFMLLFSLWRQSCRRRKLPPGPTPLPIIGNMLQIDVKDICKSFTNVSLPYVPPANCKGSQKSMVLCSPCILA

SEQ ID NO: 3876 - protein, 388 aa, Homo Sapiens
MFLQPIAKGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 3877 - protein, 420 aa, Homo Sapiens
MNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 3878 - protein, 420 aa, Homo Sapiens; identical to SEQ ID NO: 3877

SEQ ID NO: 3879 - protein, 490 aa, Homo Sapiens [sequence omitted]

SEQ ID NO: 3880 - protein, 282 aa, Homo Sapiens
MDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKLKSRKRLNV

SEQ ID NO: 3881 - protein, 162 aa, Homo Sapiens
MDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKGG

SEQ ID NO: 3882 - protein, 86 aa, Homo Sapiens
MSALGVTVALLVWAAFLLLVSMWRQVHSSWNLPPGPFPLPIIGNLFQLELKNIPKSFTRLAQRFGPVFTLYVGSQRMVVMHGYKAV

SEQ ID NO: 3883 - protein, 493 aa, Homo Sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 3884 - protein, 493 aa, Homo Sapiens; identical to SEQ ID NO: 3883

SEQ ID NO: 3885 - protein, 356 aa, Homo Sapiens
RPFPASHHREPLPVGIEEYSQVLHPGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLA

SEQ ID NO: 3886 - protein, 306 aa, Homo Sapiens
RPFPASHHREPLPVGIEEYSQVLHPGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLA

SEQ ID NO: 3887 - protein, 43 aa, Homo Sapiens
  misc_feature (1)..(1): Xaa can be any naturally occurring amino acid
XGPFPLPIIGNLFQLELKNIPKSFTRESFLIMDLPGRTSGGFP

SEQ ID NO: 3888 - protein, 172 aa, Homo Sapiens
ARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGEGRNQSLSGPISTYIPHPNSTCQILSLLPSTHSQLWMHRDIHSSSQLCSYRQVVTKILVKQ

SEQ ID NO: 3889 - protein, 491 aa, Homo Sapiens
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 3890 - protein, 320 aa, Homo Sapiens
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTPACRRRSTSWWDARGCRR

SEQ ID NO: 3891 - protein, 81 aa, Homo Sapiens
  misc_feature (1)..(1): Xaa can be any naturally occurring amino acid
XPHRVTRDTAFRGFLIPKGTDVITLLNTVHYDPSQFLTPQEFNPEHFLDANQSFKKSPAFMPFSAALDAQRHSFLLSTLLL

SEQ ID NO: 3892 - protein, 502 aa, Homo Sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 3893 - protein, 268 aa, Homo Sapiens
MPCSSKRNFCRQTMPSFIHEDDKNGRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 3894 - protein, 37 aa, Homo Sapiens
MPCSSKRNFCRQTMPSFIHEDDKNGRLTQFQIWPRMG

SEQ ID NO: 3895 - protein, 37 aa, Homo Sapiens; identical to SEQ ID NO: 3894

SEQ ID NO: 3896 - protein, 37 aa, Homo Sapiens; identical to SEQ ID NO: 3894

SEQ ID NO: 3897 - protein, 501 aa, Homo Sapiens
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 3898 - protein, 32 aa, Homo Sapiens
  misc_feature (1)..(1): Xaa can be any naturally occurring amino acid
XQSEIFADRPCLPLFMKMTKMGVLERPRSVPS

SEQ ID NO: 3899 - protein, 73 aa, Homo Sapiens
AVCWDDDGQHHGRLYPPAPDEIPSCPKARRSSPSLAPSCMTPTSSSTQKSSTQTVSWMQMDGSGSMRRSCPSP

SEQ ID NO: 3900 - protein, 175 aa, Homo Sapiens
MEATGTWALLLALALLLLLTLALSGTRARGHLPPGPTPLPLLGNLLQLRPGALYSGLMREEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFP

SEQ ID NO: 3901 - protein, 165 aa, Homo Sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGGTKPRHRIHQQEHADDSHLFAVCWDDDGQHHGRLYPPAPDEIPSCPKVGT

SEQ ID NO: 3902 - protein, 187 aa, Homo Sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGGTKPRHRIHQQEHADDSHLFAV

SEQ ID NO: 3903 - protein, 504 aa, Homo Sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 3904 - protein, 60 aa, Homo Sapiens
MLEGTFDGHGGTKPRHRIHQQEHADDSHLFAVCWDDDGQHHGRLYPPAPDEIPSCPKVGT

SEQ ID NO: 3905 - protein, 288 aa, Homo Sapiens
LQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGSEGGCGGCSCAPLGRSPPLPSRSRPGAAHSVPGHPPQAAASVLGSAWPGPSSSCCLPASCRGTACCPRLASVRPPWTPRPPGLLP

SEQ ID NO: 3906 - protein, 490 aa, Homo Sapiens
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGRRVCVGERLARTELFLLFAGLLQRYRLLPPPGVSPASLDTTPARAFTMRPRAQALCAVPRP

SEQ ID NO: 3907 - protein, 408 aa, Homo Sapiens
MELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGQQPSGPGWGGTSRAPGVGRPQLRLPPLHPPPDLRF

SEQ ID NO: 3908 - protein, 96 aa, Homo Sapiens
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKFH

SEQ ID NO: 3909 - protein, 500 aa, Homo Sapiens
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 3910 - protein, 403 aa, Homo Sapiens
MSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 3911 - protein, 164 aa, Homo Sapiens
RFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLEQCASQLLGHLPRSERAGL

SEQ ID NO: 3912 - protein, 51 aa, Homo Sapiens
  misc_feature (1)..(1): Xaa can be any naturally occurring amino acid
XPAREEEAAPGGPGEHSLPAPGGQGLGPAPPGSPEEGRGGSCRHPHTDSES

SEQ ID NO: 3913 - protein, 199 aa, Homo Sapiens
MFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 3914 - protein, 524 aa, Homo Sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 3915 - protein, 454 aa, Homo Sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGLRPLPFRPREHQGEVTSGFYSLLGRAQKLHRAGVRHG

SEQ ID NO: 3916 - protein, 524 aa, Homo Sapiens; identical to SEQ ID NO: 3914

SEQ ID NO: 3917 - protein, 454 aa, Homo Sapiens; identical to SEQ ID NO: 3915

SEQ ID NO: 3918 - protein, 520 aa, Homo Sapiens
MSQLSLSWLGLWPVAASPWLLLLLVGASWLLAHVLAWTYAFYDNCRRLRCFPQPPRRNWFWGHQGMIHSSEEGLLYTQSLACTFGDMGCWWVGPWQAVIHIFLPTCIKPVLFAPAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 3919 - protein, 89 aa, Homo Sapiens
MSQLSLSWLGLWPVAASPWLLLLLVGASWLLAHVLAWTYAFYDNCRRLRCFPQPPRRNWFWGHQGMLPLHQRTSSSTASWSPGWGMGSC

SEQ ID NO: 3920 - protein, 154 aa, Homo Sapiens
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPA

SEQ ID NO: 3921 - protein, 520 aa, Homo Sapiens
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 3922 - protein, 74 aa, Homo Sapiens
  misc_feature (1)..(1): Xaa can be any naturally occurring amino acid
XWVLYHLAKHPEYQERCRQEVQELLKDREPKEIEWSTTPFALTQRTSRRGHLWLLFPSRQGPGTASGRRSRWRR

SEQ ID NO: 3923 - protein, 381 aa, Homo Sapiens [sequence omitted]

SEQ ID NO: 3924 - protein, 136 aa, Homo Sapiens
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 3925 - protein, 76 aa, Homo Sapiens
  misc_feature (1)..(1): Xaa can be any naturally occurring amino acid
XPGPLPVLLLLLAGAPAARPTPPTCYSRMRALSQEITRDFNLLQVSEPSDLVFLLDDCNALEYPIPVTTVLPDRQR

SEQ ID NO: 3926 - protein, 92 aa, Homo Sapiens
  misc_feature (1)..(1): Xaa can be any naturally occurring amino acid
XTPGPLPVLLLLLAGAPAARPTPPTCYSRMRALSQEITRDFNLLQVSEPSEPCVRYLPRLYLDIHDLVFLLDDCNALEYPIPVTTVLPDRQR

SEQ ID NO: 3927 - protein, 78 aa, Homo Sapiens
GNTGMVGGSVPVFDEIILSTARMNRVLSFHSVSESPFYVLIETSGSNAGHDAEKLGHFLEHALGSGLVTDGTMATDQR

SEQ ID NO: 3928 - protein, 243 aa, Homo Sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGGLRPGGAEPVCGGTGLHHAAGLRSQGQLPHRGKRGNQRWRPAVSSIWLTAWDCPGPGSGAGRRHCPGLPDLPEEGQHGL

SEQ ID NO: 3929 - protein, 521 aa, Homo Sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 3930 - protein, 320 aa, Homo Sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLDAVGPEGKDHRGAEPGWLRVQVRPLPPCGAALRHRD

SEQ ID NO: 3931 - protein, 387 aa, Homo Sapiens
MVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 3932 - protein, 90 aa, Homo Sapiens [sequence omitted]

SEQ ID NO: 3933 - protein, 152 aa, Homo Sapiens
  misc_feature (1)..(1): Xaa can be any naturally occurring amino acid
XHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGFLCSALIPLQLQSPVCRPPVVLGAR

SEQ ID NO: 3934 - protein, 318 aa, Homo Sapiens
  misc_feature (1)..(1): Xaa can be any naturally occurring amino acid
XSHANHRPICLSPRIWPGSASATSTVCSSSESFLPRGPPAVSLLLHGPPTVSFPPPWPTHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPS

SEQ ID NO: 3935 - protein, 189 aa, Homo Sapiens
  misc_feature (1)..(1): Xaa can be any naturally occurring amino acid
XSVFCSDPTPTAVTCVPPACGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHL

SEQ ID NO: 3936 - protein, 9 aa, Homo Sapiens
MRMSVGLSL

SEQ ID NO: 3937 - protein, 15 aa, Homo Sapiens
MRMSVGLSLLLPLSG

SEQ ID NO: 3938 - protein, 41 aa, Homo Sapiens
MRMSVGLSLLLPLSGRTFLLLLSVVMAQSHWPSEPSEAVRD

SEQ ID NO: 3939 - protein, 52 aa, Homo Sapiens
MRMSVGLSLLLPLSGRTFLLLLSVVMAQSHWPSEPSEAVRDWENQLEASMHS

SEQ ID NO: 3940 - protein, 86 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDL

SEQ ID NO: 3941 - protein, 88 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIA

SEQ ID NO: 3942 - protein, 96 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKV

SEQ ID NO: 3943 - protein, 106 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPS

SEQ ID NO: 3944 - protein, 117 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTL

SEQ ID NO: 3945 - protein, 895 aa, Homo Sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 3946 - protein, 895 aa, Homo Sapiens; identical to SEQ ID NO: 3945

SEQ ID NO: 3947 - protein, 895 aa, Homo Sapiens; identical to SEQ ID NO: 3945

SEQ ID NO: 3948 - protein, 895 aa, Homo Sapiens; identical to SEQ ID NO: 3945

SEQ ID NO: 3949 - protein, 895 aa, Homo Sapiens; identical to SEQ ID NO: 3945

SEQ ID NO: 3950 - protein, 895 aa, Homo Sapiens; identical to SEQ ID NO: 3945

SEQ ID NO: 3951 - protein, 189 aa, Homo Sapiens
MLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKA

SEQ ID NO: 3952 - protein, 163 aa, Homo Sapiens
MPLTRQQGRLLVTLSPVRTDRQADRRTDKQMLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQTRESRYVAQASLELLASSNPPTSAS

SEQ ID NO: 3953 - protein, 167 aa, Homo Sapiens
MFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIR

SEQ ID NO: 3954 - protein, 197 aa, Homo Sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQP

SEQ ID NO: 3955 - protein, 347 aa, Homo Sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 3956 - protein, 123 aa, Homo Sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPLWLVPHKPNSGGKELSTVAD

SEQ ID NO: 3957 - protein, 281 aa, Homo Sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 3958 - protein, 78 aa, Homo Sapiens
MRVVVIGAGVIGLSTALCIHERYHSVLQPLDIKVYADRFTPLTTTDVAAGLWQPYLSDPNNPQEATLPGRTQFWDFGS

SEQ ID NO: 3959 - protein, 73 aa, Homo Sapiens
MNSKGQYPTQPTYPVQPPGNPVYPQTLHLPQAPPYTDAPPAYSEGLPQSPPCQPHFLEPLCIFPWPSLWLLGL

SEQ ID NO: 3960 - protein, 207 aa, Homo Sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPASTSWMPSQCCSACSHAGSQRPRNSAEGELLHGWFRWWLHHLVRNQGHLCAGKDITYLQHFSQCNCFSHINLKLQFRHMLLGCLSGAQTFRHFSNLIRNHVMVAVPP

SEQ ID NO: 3961 - protein, 168 aa, Homo Sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 3962 - protein, 134 aa, Homo Sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPVCVLKLGR

SEQ ID NO: 3963 - protein, 153 aa, Homo Sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPVKEDQDHDREQGEEDNGDNNLERRGKM

SEQ ID NO: 3964 - protein, 146 aa, Homo Sapiens
MNSKGQYPTQPTYPVQPPGNPVYPQTLHLPQAPPYTDAPPAYSELYRPSFVHPGAATVPTMSAAIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 3965 - protein, 86 aa, Homo Sapiens
MNSKGQYPTQPTYPVQPPGNPVYPQTLHLPQAPPYTDAPPAYSEPPPPGCPPNAAQLAVMQGANVLVTQRKGNFFMGGSDGGYTIW

SEQ ID NO: 3966 - protein, 136 aa, Homo Sapiens
MNSKGQYPTQPTYPVQPPGNPVYPQTLHLPQAPPYTDAPPAYSESVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 3967 - protein, 108 aa, Homo Sapiens
MSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 3968 - protein, 617 aa, Homo Sapiens
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 3969 - protein, 244 aa, Homo Sapiens
MREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAK

SEQ ID NO: 3970 - protein, 27 aa, Homo Sapiens
MAANLSRNGPALQEAYVRVVTEKSPTD

SEQ ID NO: 3971 - protein, 50 aa, Homo Sapiens
MAANLSRNGPALQEAYVRVVTEKSPTDWALFTYEGNSNDIRCCSCCRGPM

SEQ ID NO: 3972 - protein, 87 aa, Homo Sapiens
MAANLSRNGPALQEAYVRVVTEKSPTDWALFTYEGNSNDIRVAGTGDRRGRERCAEGSLCQPRQHHGQLPEGGPCDHQRTGRGGCGA

SEQ ID NO: 3973 - protein, 406 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3974 - protein, 430 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3975 - protein, 431 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3976 - protein, 439 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQGSTCASLQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3977 - protein, 382 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3978 - protein, 128 aa, Homo Sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKVRPGGPCDHQRTGRGGCGA

SEQ ID NO: 3979 - protein, 62 aa, Homo Sapiens
MAANLSRNGPALQEAYVRVVTEKSPTDWALFTYEGNSNDIRVAGTGGGPCDHQRTGRGGCGA

SEQ ID NO: 3980 - protein, 31 aa, Homo Sapiens
MAANLSRNGPALQEAYVRVVTEKSPTDWGPM

SEQ ID NO: 3981 - protein, 40 aa, Homo Sapiens
MAANLSRNGPALQEAYVRVVTEKSPTDWWAARRARGSLYL

SEQ ID NO: 3982 - protein, 48 aa, Homo Sapiens
MAANLSRNGPALQEAYVRVVTEKSPTDWWAARRARVGPGAASGGSLYL

SEQ ID NO: 3983 - protein, 48 aa, Homo Sapiens; identical to SEQ ID NO: 3982

SEQ ID NO: 3984 - protein, 327 aa, Homo Sapiens
MASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3985 - protein, 336 aa, Homo Sapiens
MKATAMTSAWLAQGGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3986 - protein, 359 aa, Homo Sapiens
  misc_feature (1)..(1): Xaa can be any naturally occurring amino acid
XATAMTSAWLAQGTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3987 - protein, 138 aa, Homo Sapiens
  misc_feature (1)..(1): Xaa can be any naturally occurring amino acid
XKQKERAMSTTSISSPQPDLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 3988 - protein, 77 aa, Homo Sapiens
MRFMTLLFLTALAGALVCAYDPEAASAPGSGNHKQMDCLQLQKPPSETAKFLSSSTNLPRREKLVPSAKPPHTRGLV

SEQ ID NO: 3989 - protein, 110 aa, Homo Sapiens
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 3990 - protein, 121 aa, Homo Sapiens
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGGEERLVFGAPVNLTSIPLTSVSRP

SEQ ID NO: 3991 - protein, 100 aa, Homo Sapiens
MKATIILLLLAQVSWAGPFQQRGLFDFMLEDEASGIGPEVPDDRDFEPSLGPVCPFRCQCHLRVVQCSDLEKFGLEIPRALHLEDKSPERLKLSGWAKGE

SEQ ID NO: 3992 - protein, 98 aa, Homo Sapiens
MKATIILLLLAQVSWAGPFQQRGLFDFMLEDEASGIGPEVPDDRDFEPSLGPVCPFRCQCHLRVVQCSDLEKKYCNNLSSYNLYTTNCLILCRLFTHH

SEQ ID NO: 3993 - protein, 98 aa, Homo Sapiens; identical to SEQ ID NO: 3992

SEQ ID NO: 3994 - protein, 250 aa, Homo Sapiens
MKATIILLLLAQVSWAGPFQQRGLFDFMLEDEASGIGPEVPDDRDFEPSLGPVCPFRCQCHLRVVQCSDLELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 3995 - protein, 75 aa, Homo Sapiens
MKATIILLLLAQVSWAGPFQQRGLFDFMLEDEASGIGPEVPDDRDFEPSLGPVCPFRCQCHLRVVQCSDLGCLPS

SEQ ID NO: 3996 - protein, 119 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISK

SEQ ID NO: 3997 - protein, 174 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLN

SEQ ID NO: 3998 - protein, 178 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIV

SEQ ID NO: 3999 - protein, 179 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVI

SEQ ID NO: 4000 - protein, 359 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 4001 - protein, 359 aa, Homo Sapiens; identical to SEQ ID NO: 4000

SEQ ID NO: 4002 - protein, 359 aa, Homo Sapiens; identical to SEQ ID NO: 4000

SEQ ID NO: 4003 - protein, 172 aa, Homo Sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHVVYLHNNNISVVGSSDFCPPGHNTKKASYSGVSLFSNPVQYWEIQPSTFRCVYVRSAIQLGNYK

SEQ ID NO: 4004 - protein, 177 aa, Homo Sapiens
MKATIILLLLAQVSWAGPFQQRGLFDFMLEDEASGIGPEVPDDRDFEPSLGPVCPFRCQCHLRVVQCSDLGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASY

SEQ ID NO: 4005 - protein, 212 aa, Homo Sapiens
MKATIILLLLAQVSWAGPFQQRGLFDFMLEDEASGIGPEVPDDRDFEPSLGPVCPFRCQCHLRVVQCSDLGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 4006 - protein, 212 aa, Homo Sapiens; identical to SEQ ID NO: 4005

SEQ ID NO: 4007 - protein, 88 aa, Homo Sapiens
MKATIILLLLAQVSWAGPFQQRGLFDFMLEDEASGIGPEVPDDRDFEPSLGPVCPFRCQCHLRVVQCSDLVETGFHRVSQDGLDLLIS

SEQ ID NO: 4008 - protein, 52 aa, Homo Sapiens
  misc_feature (1)..(1): Xaa can be any naturally occurring amino acid
XDFCPPGHNTKKASYSGVSLFSNPVQYWEIQPSTFRCVYVRSAIQLGNYKKK

SEQ ID NO: 4009 - protein, 95 aa, Homo Sapiens
  misc_feature (1)..(1): Xaa can be any naturally occurring amino acid
XKISRVDAASLKGLNNLAKLGLSFNSISAVDNGSLANTPHLRELHLDNNKLTRVPGGLAEHKYIQVMQSHCLCEEYPKSKTPTLLMGCWEAGSSS

SEQ ID NO: 4010 - protein, 66 aa, Homo Sapiens
MNRRRKFLLASVLALQNSSFIYPSCQKCFSRIILVSKRILKTNLDKVQMPVTSYSNALTTKEKPKH

SEQ ID NO: 4011 - protein, 75 aa, Homo Sapiens
MNRRRKFLLASVLALQNSSFIYPSCQKCFSRIILVSKRSNCPKCGSTGESGNANYRYKLSLKVAESNKLFVITVF

SEQ ID NO: 4012 - protein, 76 aa, Homo Sapiens
MNRRRKFLLASVLALQNSSFIYPSCQKCFSRIILVSKRSNCPKCGSTGESGNANYRYKLSLKVAESNKLFVITVFG

SEQ ID NO: 4013 - protein, 120 aa, Homo Sapiens
MNRRRKFLLASVLALQNSSFIYPSCQKCFSRIILVSKRSNCPKCGSTGESGNANYRYKLSLKVAESNKLFVITVFGSCLDTFFGLTATGLHRILKTNLDKVQMPVTSYSNALTTKEKPKH

SEQ ID NO: 4014 - protein, 120 aa, Homo Sapiens; identical to SEQ ID NO: 4013

SEQ ID NO: 4015 - protein, 123 aa, Homo Sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVG

SEQ ID NO: 4016 - protein, 178 aa, Homo Sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPATQDAKTK

SEQ ID NO: 4017 - protein, 998 aa, Homo Sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 4018 - protein, 998 aa, Homo Sapiens; identical to SEQ ID NO: 4017

SEQ ID NO: 4019 - protein, 225 aa, Homo Sapiens
MYQMSTLKSNKVIFQLKKNNFHQFRFFKRFIWSFALVAQAEVPWCNLGSLQPPHPRPRCEHMNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQ

SEQ ID NO: 4020 - protein, 439 aa, Homo Sapiens
MEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 4021 - protein, 155 aa, Homo Sapiens [sequence omitted]

SEQ ID NO: 4022 - protein, 456 aa, Homo Sapiens
MGYFRCARAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 4023 - protein, 456 aa, Homo Sapiens; identical to SEQ ID NO: 4022

SEQ ID NO: 4024 - protein, 41 aa, Homo Sapiens
MGPEALSSLLLLLLVASGDADMKGHFDPAKCRYALGMQDRT

SEQ ID NO: 4025 - protein, 51 aa, Homo Sapiens
MGPEALSSLLLLLLVASGDADMKGHFDPAKCRYALGMQDRTIPDSDISASS

SEQ ID NO: 4026 - protein, 51 aa, Homo Sapiens; identical to SEQ ID NO: 4025

SEQ ID NO: 4027 - protein, 55 aa, Homo Sapiens
MGPEALSSLLLLLLVASGDADMKGHFDPAKCRYALGMQDRTIPDSDISASSSWSD

SEQ ID NO: 4028 - protein, 58 aa, Homo Sapiens
MGPEALSSLLLLLLVASGDADMKGHFDPAKCRYALGMQDRTIPDSDISASSSWSDSTA

SEQ ID NO: 4029 - protein, 70 aa, Homo Sapiens
MGPEALSSLLLLLLVASGDADMKGHFDPAKCRYALGMQDRTIPDSDISASSSWSDSTAARHSRLESSDGD

SEQ ID NO: 4030 - protein, 73 aa, Homo Sapiens
MGPEALSSLLLLLLVASGDADMKGHFDPAKCRYALGMQDRTIPDSDISASSSWSDSTAARHSRLESSDGDGAW

SEQ ID NO: 4031 - protein, 78 aa, Homo Sapiens
MGPEALSSLLLLLLVASGDADMKGHFDPAKCRYALGMQDRTIPDSDISASSSWSDSTAARHSRLESSDGDGAWCPAGS

SEQ ID NO: 4032 - protein, 85 aa, Homo Sapiens
MGPEALSSLLLLLLVASGDADMKGHFDPAKCRYALGMQDRTIPDSDISASSSWSDSTAARHSRLESSDGDGAWCPAGSVFPKEEE

SEQ ID NO: 4033 - protein, 101 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVG

SEQ ID NO: 4034 - protein, 112 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGK

SEQ ID NO: 4035 - protein, 115 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFS

SEQ ID NO: 4036 - protein, 122 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRY

SEQ ID NO: 4037 - protein, 127 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGR

SEQ ID NO: 4038 - protein, 132 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGW

SEQ ID NO: 4039 - protein, 138 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQ

SEQ ID NO: 4040 - protein, 138 aa, Homo Sapiens; identical to SEQ ID NO: 4039

SEQ ID NO: 4041 - protein, 143 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISG

SEQ ID NO: 4042 - protein, 147 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDP

SEQ ID NO: 4043 - protein, 153 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLK

SEQ ID NO: 4044 - protein, 160 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMV

SEQ ID NO: 4045 - protein, 170 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 4046 - protein, 243 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDCSMGVWASWQMVWWGWMTLGRVRSCGSGQAMTMWDGATTASPVAMWRWSLSLTG

SEQ ID NO: 4047 - protein, 243 aa, Homo Sapiens; identical to SEQ ID NO: 4046

SEQ ID NO: 4048 - protein, 209 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVY

SEQ ID NO: 4049 - protein, 913 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 4050 - protein, 876 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 4051 - protein, 876 aa, Homo Sapiens; identical to SEQ ID NO: 4050

SEQ ID NO: 4052 - protein, 913 aa, Homo Sapiens; identical to SEQ ID NO: 4049

SEQ ID NO: 4053 - protein, 267 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGY

SEQ ID NO: 4054 - protein, 876 aa, Homo Sapiens; identical to SEQ ID NO: 4050

SEQ ID NO: 4055 - protein, 767 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 4056 - protein, 876 aa, Homo Sapiens; identical to SEQ ID NO: 4050

SEQ ID NO: 4057 - protein, 876 aa, Homo Sapiens; identical to SEQ ID NO: 4050

SEQ ID NO: 4058 - protein, 919 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 4059 - protein, 286 aa, Homo Sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVH

SEQ ID NO: 4060 - protein, 913 aa, Homo Sapiens; identical to SEQ ID NO: 4049

SEQ ID NO: 4061 - protein, 35 aa, Homo Sapiens
MGPEALSSLLLLLLVASGDADMKGHFDPGPDHPRQ

SEQ ID NO: 4062 - protein, 35 aa, Homo Sapiens; identical to SEQ ID NO: 4061

SEQ ID NO: 4063 - protein, 196 aa, Homo Sapiens
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 4064 - protein, 894 aa, Homo Sapiens
MSLPRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 4065 - protein, 69 aa, Homo Sapiens
MVARLVRFYPRADRVMSVCLRVELYGCLWRDGLLSYTAPVGQTMYLSEAVYLNDSTYDGHTVGGLQYGG

SEQ ID NO: 4066 - protein, 493 aa, Homo Sapiens
SEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLN

SEQ ID NO: 4067 - protein, 172 aa, Homo Sapiens
  misc_feature (1)..(1): Xaa can be any naturally occurring amino acid
XNNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVK

SEQ ID NO: 4068 - protein, 277 aa, Homo Sapiens
  misc_feature (1)..(1): Xaa can be any naturally occurring amino acid
XRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVRVEEREDGSEAGDRRGRVVILETKEYLFPDSHPHCHNAGVPVPAACLPAGPI

SEQ ID NO: 4069 - protein, 196 aa, Homo Sapiens
  misc_feature (1)..(1): Xaa can be any naturally occurring amino acid
XSLLLLLLVASGDADMKGHFDPAKCRYALGMQDRTIPDSDISASSSWLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLND

SEQ ID NO: 4070 - protein, 166 aa, Homo Sapiens
LKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRVSREKPQQASGRYDTPAPSSLHLFLVSANLLRSPHSLSRFGLPLLLA

SEQ ID NO: 4071 - protein, 130 aa, Homo Sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWI

SEQ ID NO: 4072 - protein, 148 aa, Homo Sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPY

SEQ ID NO: 4073 - protein, 855 aa, Homo Sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 4074 - protein, 855 aa, Homo Sapiens; identical to SEQ ID NO: 4073

SEQ ID NO: 4075 - protein, 171 aa, Homo Sapiens
  misc_feature (1)..(1): Xaa can be any naturally occurring amino acid
XIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVS

SEQ ID NO: 4076 - protein, 166 aa, Homo Sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRFQVKFTGDSQSSERPLAWMSRHLLSGSCIAGGPQTNLEMNHLQLATSSSVNTGEKTSLPHKKRLQPKPGVL

SEQ ID NO: 4077 - protein, 118 aa, Homo Sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 4078 - protein, 118 aa, Homo Sapiens; identical to SEQ ID NO: 4077

SEQ ID NO: 4079 - protein, 107 aa, Homo Sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRQVPGEVHGRLTE

SEQ ID NO: 4080 - protein, 132 aa, Homo Sapiens
MQLFLLAVSVPLPAMPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 4081 - protein, 50 aa, Homo Sapiens
  misc_feature (1)..(1): Xaa can be any naturally occurring amino acid
XKDLPPPQEASATQTWRSVTELKFPLGILIRFFPLESWQIGKIGTVMTFL

SEQ ID NO: 4082 - protein, 729 aa, Homo Sapiens
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 4083 - protein, 731 aa, Homo Sapiens
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGKGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 4084 - protein, 729 aa, Homo Sapiens; identical to SEQ ID NO: 4082

SEQ ID NO: 4085 - protein, 731 aa, Homo Sapiens; identical to SEQ ID NO: 4083

SEQ ID NO: 4086 - protein, 56 aa, Homo Sapiens
  misc_feature (1)..(1): Xaa can be any naturally occurring amino acid
XWPAMCIHGDKSQPERDWVLNEFRSGKAPILIATDVASRGLGSPALGNQMGLQRSI

SEQ ID NO: 4087 - protein, 138 aa, Homo Sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQAELSNS

SEQ ID NO: 4088 - protein, 824 aa, Homo Sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQRVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 4089 - protein, 432 aa, Homo Sapiens [sequence omitted]

SEQ ID NO: 4090 - protein, 191 aa, Homo Sapiens
ASVRSGASDAGGEMREGFGRGPQRETPSPPPREFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYEL

SEQ ID NO: 4091 - protein, 468 aa, Homo Sapiens
IAAMASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFSK

SEQ ID NO: 4092 - protein, 483 aa, Homo Sapiens
MASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 4093 - protein, 369 aa, Homo Sapiens
MGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 4094 - protein, 197 aa, Homo Sapiens
MGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRIIWLLVAKETTDNFQLPSLTLELYRDIMETPHSFLLLSQGTWRI

SEQ ID NO: 4095 - protein, 67 aa, Homo Sapiens
  misc_feature (1)..(1): Xaa can be any naturally occurring amino acid
XGIDVKQVTIVVNFDLPVKQGEEPDYETYLHRIGRTGRFGKKGLAFNMIEVDELPSLMKIQDHFRKS

SEQ ID NO: 4096 - protein, 407 aa, Homo Sapiens
  misc_feature (1)..(1): Xaa can be any naturally occurring amino acid
XLVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRNWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 4097 - protein, 540 aa, Homo Sapiens
MALTRPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 4098 - protein, 565 aa, Homo Sapiens
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 4099 - protein, 349 aa, Homo Sapiens
  misc_feature (1)..(1): Xaa can be any naturally occurring amino acid
XLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 4100 - protein, 86 aa, Homo Sapiens
  misc_feature (1)..(1): Xaa can be any naturally occurring amino acid
XPVLSRDEDSEEDADSEAERETPRVTAVAVMAAEPGHMDMGAEALPGPDEAAAAAAFAGKCARRPLASSGSRAPTPRACPAQLSQR

SEQ ID NO: 4101 - protein, 136 aa, Homo Sapiens
MAILSLRAPGPWQAMQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPN

SEQ ID NO: 4102 - protein, 512 aa, Homo Sapiens
MAILSLRAPGPWQAMQVWADRTLLTPHTGVTSQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4103 - protein, 125 aa, Homo Sapiens
MDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLI

SEQ ID NO: 4104 - protein, 391 aa, Homo Sapiens
MDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4105 - protein, 66 aa, Homo Sapiens
MEYDEKLARFRQAHLNPFNKQSGPRQHEQGPGEEVPDVTPEEALPELPPGEPEFRCPERVMDLGLS

SEQ ID NO: 4106 - protein, 107 aa, Homo Sapiens
MEYDEKLARFRQAHLNPFNKQSGPRQHEQGPGEEVPDVTPEEALPELPPGEPEFRCPERVMDLGLSEDHFSRPVDGPLTAPAPNLGRVCSWPLTSSSCGRRSRSASR

SEQ ID NO: 4107 - protein, 106 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQ

SEQ ID NO: 4108 - protein, 134 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIR

SEQ ID NO: 4109 - protein, 150 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVK

SEQ ID NO: 4110 - protein, 451 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4111 - protein, 451 aa, Homo Sapiens; identical to SEQ ID NO: 4110

SEQ ID NO: 4112 - protein, 434 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4113 - protein, 451 aa, Homo Sapiens; identical to SEQ ID NO: 4110

SEQ ID NO: 4114 - protein, 197 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 4115 - protein, 197 aa, Homo Sapiens; identical to SEQ ID NO: 4114

SEQ ID NO: 4116 - protein, 176 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKRCQAKGFVCELCREGDVLFPFDSHTSVCADCSAVFHRDCYYDNSTTCPKCAR

SEQ ID NO: 4117 - protein, 441 aa, Homo Sapiens
MEYDEKLARFRQAHLNPFNKQSGPRQHEQGPGEEVPDVTPEEALPELPPGEPEFRCPERVMDLGLSEDHFSRPVLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4118 - protein, 127 aa, Homo Sapiens
MEYDEKLARFRQAHLNPFNKQSGPRQHEQGPGEEVPDVTPEEALPELPPGEPEFRCPERVMDLGLSEDHFSRPVQLRQAIEECKQVILELPEQSEKQKDAVVRLIHLRLKLQELKDPNEDEPNIRVL

SEQ ID NO: 4119 - protein, 177 aa, Homo Sapiens
MRGGGQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLN

SEQ ID NO: 4120 - protein, 186 aa, Homo Sapiens
MRGGGQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQT

SEQ ID NO: 4121 - protein, 94 aa, Homo Sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 4122 - protein, 94 aa, Homo Sapiens; identical to SEQ ID NO: 4121

SEQ ID NO: 4123 - protein, 94 aa, Homo Sapiens; identical to SEQ ID NO: 4121

SEQ ID NO: 4124 - protein, 94 aa, Homo Sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 4125 - protein, 97 aa, Homo Sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 4126 - protein, 94 aa, Homo Sapiens
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 4127 - protein, 100 aa, Homo Sapiens
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 4128 - protein, 68 aa, Homo Sapiens
MRTSYLLLFTLCLLLSEMASGGNFLTGLGHRSDHYNCVSSGGQCLYSACPIFTKIQGTCYRGKAKCCK

SEQ ID NO: 4129 - protein, 67 aa, Homo Sapiens
MRIHYLLFALLFLFLVPVPGHGGIINTLQKYYCRVRGGRCAVLSCLPKEEQIGKCSTRGRKCCRRKK

SEQ ID NO: 4130 - protein, 67 aa, Homo Sapiens; identical to SEQ ID NO: 4129

SEQ ID NO: 4131 - protein, 72 aa, Homo Sapiens
MQRLVLLLAISLLLYQDLPVRSEFELDRICGYGTARCRKKCRSQEYRIGRCPNTYACCLRKWDESLLNRTKP

SEQ ID NO: 4132 - protein, 72 aa, Homo Sapiens; identical to SEQ ID NO: 4131

SEQ ID NO: 4133 - protein, 78 aa, Homo Sapiens
MALIRKTFYFLFAMFFILVQLPSGCQAGLDFSQPFPSGEFAVCESCKLGRGKCRKECLENEKPDGNCRLNFLCCRQRI

SEQ ID NO: 4134 - protein, 78 aa, Homo Sapiens; identical to SEQ ID NO: 4133

SEQ ID NO: 4135 - protein, 65 aa, Homo Sapiens
MRTFLFLFAVLFFLTPAKNAFFDEKCNKLKGTCKNNCGKNEELIALCQKSLKCCRTIQPCGSIID

SEQ ID NO: 4136 - protein, 65 aa, Homo Sapiens; identical to SEQ ID NO: 4135

SEQ ID NO: 4137 - protein, 70 aa, Homo Sapiens
MPGAMKIFVFILAALILLAQIFQARTAIHRALISKRMEGHCEAECLTFEVKIGGCRAELAPFCCKNRKKH

SEQ ID NO: 4138 - protein, 70 aa, Homo Sapiens; identical to SEQ ID NO: 4137

SEQ ID NO: 4139 - protein, 73 aa, Homo Sapiens
MRIAVLLFAIFFFMSQVLPARGKFKEICERPNGSCRDFCLETEIHVGRCLNSQPCCLPLGHQPRIESTTPKKD

SEQ ID NO: 4140 - protein, 67 aa, Homo Sapiens
MKIQLFFFILHFWVTILPAKKKYPEYGSLDLRRECRIGNGQCKNQCHENEIRIAYCIRPGTHCCLQQ

SEQ ID NO: 4141 - protein, 62 aa, Homo Sapiens
MKIQLFFFILHFWVTILPARSNFEPKYRFERCEKVRGICKTFCDDVEYDYGYCIKWRSQCCV

SEQ ID NO: 4142 - protein, 82 aa, Homo Sapiens
MKILCIFLTFVFTVSCGPSVPQKKTREVAERKRECQLVRGACKPECNSWEYVYYYCNVNPCCAVWEYQKPIINKITSKLHQK

SEQ ID NO: 4143 - protein, 69 aa, Homo Sapiens
MRIFYYLHFLCYVTFILPATCTLVNADRCTKRYGRCKRDCLESEKQIDICSLPRKICCTEKLYEEDDMF

SEQ ID NO: 4144 - protein, 88 aa, Homo Sapiens
MLPDHFSPLSGDIKLSVLALVVLVVLAQTAPDGWIRRCYYGTGRCRKSCKEIERKKEKCGEKHICCVPKEKDKLSHIHDQKETSELYI

SEQ ID NO: 4145 - protein, 102 aa, Homo Sapiens
MSVMKPCLMTIAILMILAQKTPGGLFRSHNGKSREPWNPCELYQGMCRNACREYEIQYLTCPNDQKCCLKLSVKITSSKNVKEDYDSNSNLSVTNSSSYSHI

SEQ ID NO: 4146 - protein, 123 aa, Homo Sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 4147 - protein, 43 aa, Homo Sapiens
MKLLYLFLAILLAIEEPVISALVRTVGCCLDTARQTPHPSMHG

SEQ ID NO: 4148 - protein, 84 aa, Homo Sapiens
MKLLYLFLAILLAIEEPVISGKRHILRCMGNSGICRASCKKNEQPYLYCRNCQSCCLQSYMRISISGKEENTDWSYEKQWPRLP

SEQ ID NO: 4149 - protein, 88 aa, Homo Sapiens
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 4150 - protein, 76 aa, Homo Sapiens
MKLLLLLLTVTLLLAQVTPVMKCWGKSGRCRTTCKESEVYYILCKTEAKCCVDPKYVPVKPKLTDTNTSLESTSAV

SEQ ID NO: 4151 - protein, 67 aa, Homo Sapiens
MKLLLLTLTVLLLLSQLTPGGTQRCWNLYGKCRYRCSKKERVYVYCINNKMCCVKPKYQPKERWWPF

SEQ ID NO: 4152 - protein, 71 aa, Homo Sapiens
MTQLLLFLVALLVLGHVPSGRSEFKRCWKGQGACQTYCTRQETYMHLCPDASLCCLSYALKPPPVPKHEYE

SEQ ID NO: 4153 - protein, 156 aa, Homo Sapiens
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 4154 - protein, 111 aa, Homo Sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 4155 - protein, 99 aa, Homo Sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 4156 - protein, 93 aa, Homo Sapiens
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 4157 - protein, 183 aa, Homo Sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 4158 - protein, 79 aa, Homo Sapiens
MKLHSLISVLLLFVTLIPKGKTGVIPGQKQCIALKGVCRDKLCSTLDDTIGICNEGKKCCRRWWILEPYPTPVPKGKSP

SEQ ID NO: 4159 - protein, 79 aa, Homo Sapiens; identical to SEQ ID NO: 4158

SEQ ID NO: 4160 - protein, 70 aa, Homo Sapiens
MRVLFFVFGVLSLMFTVPPARSFISNDECPSEYYHCRLKCNADEHAIRYCADFSICCKLKIIEIDGQKKW

SEQ ID NO: 4161 - protein, 70 aa, Homo Sapiens
MRVLFFVFGVLSLMSTVPPTRSFTSNDECPSEYYHCRLKCNADEHAIRYCADFSICCKLKIIQIDGQKKW

SEQ ID NO: 4162 - protein, 95 aa, Homo Sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 4163 - protein, 61 aa, Homo Sapiens
MKIHVFLFVLFFFLVPIATRVKCAVKDTYSCFIMRGKCRHECHDFEKPIGFCTKLNANCYM

SEQ ID NO: 4164 - protein, 66 aa, Homo Sapiens
MKPLLVVFVFLFLWDPVLAGINSLSSEMHKKCYKNGICRLECYESEMLVAYCMFQLECCVKGNPAP

SEQ ID NO: 4165 - protein, 66 aa, Homo Sapiens; identical to SEQ ID NO: 4164

SEQ ID NO: 4166 - protein, 77 aa, Homo Sapiens
MATRSVLLALVVLNLLFYVPPGRSGPNVYIQKIFASCWRLQGTCRPKCLKNEQYRILCDTIHLCCVNPKYLPILTGK

SEQ ID NO: 4167 - protein, 78 aa, Homo Sapiens
MNLCLSALLFFLVILLPSGKGMFGNDGVKVRTCTSQKAVCFFGCPPGYRWIAFCHNILSCCKNMTRFQPPQAKDPWVH

SEQ ID NO: 4168 - protein, 64 aa, Homo Sapiens
MRVLYLLFSFLFIFLMPLPGVFGGIGDPVTCLKSGAICHPVFCPRRYKQIGTCGLPGTKCCKKP

SEQ ID NO: 4169 - protein, 64 aa, Homo Sapiens; identical to SEQ ID NO: 4168

SEQ ID NO: 4170 - protein, 84 aa, Homo Sapiens
MRSRLLLSVAHLPTIRETTEEMLLGGPGQEPPPSPSLDDYVRSISRLAQPTSVLDKATAQGQPRPPHRPAQACRKGRPAVSLRD

SEQ ID NO: 4171 - protein, 212 aa, Homo Sapiens
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 4172 - protein, 326 aa, Homo Sapiens
MSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4173 - protein, 550 aa, Homo Sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4174 - protein, 550 aa, Homo Sapiens [sequence omitted]

SEQ ID NO: 4175 - protein, 509 aa, Homo Sapiens
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4176 - protein, 396 aa, Homo Sapiens
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 4177 - protein, 155 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRR

SEQ ID NO: 4178 - protein, 192 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRRLGEPEDCAGIVSFLCSEDASYITGETVVVGGGTPSRL

SEQ ID NO: 4179 - protein, 188 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKRRLSGDRVFHSSLQSISSLDGQGKRGKHERNPADKKVRRARGLCWHRVFPVL

SEQ ID NO: 4180 - protein, 278 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 4181 - protein, 158 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 4182 - protein, 244 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 4183 - protein, 199 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPLWMDKEKEESMKETLRIRRLGEPEDCAGIVSFLCSEDASYITGETVVVGGGTPSRL

SEQ ID NO: 4184 - protein, 61 aa, Homo Sapiens
RNIRVNCLAPGLIKTSFSRMLWMDKEKEESMKETLRIRRPRIHKHYHYSDLSKKSASLSKG

SEQ ID NO: 4185 - protein, 90 aa, Homo Sapiens
MAVKLHGGIDILVSNAAVNPFFGSLMDVTEEVWDKGFSPYNVSKTALLGLNNTLAIELAPRNIRVNCLHLDLSRLASAGCSGWTRKKRKA

SEQ ID NO: 4186 - protein, 131 aa, Homo Sapiens
MAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4187 - protein, 49 aa, Homo Sapiens
MDVTEEVWDKTLDINVKAPALMTKAVVPEMEKRGGGSVVIVSSIAAFSP

SEQ ID NO: 4188 - protein, 215 aa, Homo Sapiens
MPFPCLSLPSSWDYRIGFAIARRLAQDRAHVVVSSRKQQNVDQAVATLQGEGLSVTGTVCHVGKAEDRERLVAMTLDINVKAPALMTKAVVPEMEKRGGGSVVIVSSIAAFSPSPGFSPYNVSKTALLGLNNTLAIELAPRNIRVNCLPGLIKTSFSRMLWMDKEKEESMKETLRIRRLGEPEDCAGIVSFLCSEDASYITGETVVVGGGTPSRL

SEQ ID NO: 4189 - protein, 192 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKLWMDKEKEESMKETLRIRRLGEPEDCAGIVSFLCSEDASYITGETVVVGGGTPSRL

SEQ ID NO: 4190 - protein, 232 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4191 - protein, 242 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGWLGEPEDCAGIVSFLCSEDAS

SEQ ID NO: 4192 - protein, 157 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMGFSPYNVSKTALLGLNNTLAIELAPRNIRVNCLHLDLSRLASAGCSGWTRKKRKA

SEQ ID NO: 4193 - protein, 157 aa, Homo Sapiens; identical to SEQ ID NO: 4192

SEQ ID NO: 4194 - protein, 109 aa, Homo Sapiens
  misc_feature (1)..(1): Xaa can be any naturally occurring amino acid
XSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4195 - protein, 61 aa, Homo Sapiens
MNWELLLWLLVLCALLLLLVQLLRFLRADGDLTLLWAEWQGRRPEWELTDMVVWVTGASSG

SEQ ID NO: 4196 - protein, 339 aa, Homo Sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 4197 - protein, 339 aa, Homo Sapiens; identical to SEQ ID NO: 4196

SEQ ID NO: 4198 - protein, 376 aa, Homo Sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITTRWGRKGLRTLRVVWMQTLLILKSLRQNMTEKSTCTFQATGGRNGKHENSNLLMLLNNQRLICDFTF

SEQ ID NO: 4199 - protein, 289 aa, Homo Sapiens
MVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 4200 - protein, 212 aa, Homo Sapiens
  misc_feature (1)..(1): Xaa can be any naturally occurring amino acid
XILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLMQTLLILKSLRQNMTEKSTCTFQATGGRNGKHENSNLLMLLNNQRLICDFTF

SEQ ID NO: 4201 - protein, 399 aa, Homo Sapiens
  misc_feature (1)..(1): Xaa can be any naturally occurring amino acid
XLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVVRPISKFLNSMYQSCRKVQNFPVFKKLSGWVQWLMSVIPALWEAKADHLRPGVQDQPGQHSETPSLLKIQKVAGHGGACL

SEQ ID NO: 4202 - protein, 160 aa, Homo Sapiens
  misc_feature (1)..(1): Xaa can be any naturally occurring amino acid
XNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRGFFNGLRTELATYPGIIVSNICPGPVQSN

SEQ ID NO: 4203 - protein, 312 aa, Homo Sapiens
MGVMAMLMLPLLLLGISGLLFIYQEVSRLWSKSAVQNKVVVITDAISGLGKECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 4204 - protein, 311 aa, Homo Sapiens
MGVMAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 4205 - protein, 132 aa, Homo Sapiens
SVKVKGPAHKISLELDKKIMDANYFGPITLTKALLPNMISRRTGQIVLVNNIQGKFGIPFRTTFFFRKLTYGVHPVEVAEEVMRTVRRKKQEVFMANPIPKAAVYVRTFFPEFFFAVVACGVKEKLNVPEEG

SEQ ID NO: 4206 - protein, 66 aa, Homo Sapiens
MLFWVLGLLILCGFLWTRKGKLKIEDITDKYIFITGCDSGFGNLAARTFDKKGFHVIAACLTESGS

SEQ ID NO: 4207 - protein, 319 aa, Homo Sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4208 - protein, 319 aa, Homo Sapiens; identical to SEQ ID NO: 4207

SEQ ID NO: 4209 - protein, 319 aa, Homo Sapiens; identical to SEQ ID NO: 4207

SEQ ID NO: 4210 - protein, 319 aa, Homo Sapiens; identical to SEQ ID NO: 4207

SEQ ID NO: 4211 - protein, 319 aa, Homo Sapiens; identical to SEQ ID NO: 4207

SEQ ID NO: 4212 - protein, 172 aa, Homo Sapiens
MLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4213 - protein, 379 aa, Homo Sapiens
MPEGRSHCACSITSLTLLVSLTRVTLDILQKLDPPQPAHWRHHLLVLYKKGVYLSHTGGKMLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4214 - protein, 122 aa, Homo Sapiens
MHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVA

SEQ ID NO: 4215 - protein, 63 aa, Homo Sapiens
MPVFPPRPDRVAIVTGGTDGIGYSTAKHLARLGMHVIIAGNNDSKAKQVVSKIKEETLNDKET

SEQ ID NO: 4216 - protein, 330 aa, Homo Sapiens
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWATRLAKKLLGWLLFKTPDEGAWTSIYAAVTPELEGVGGHYLYNEKETKSLHVTYNQKLQQQLWSKSCEMTGVLDVTL

SEQ ID NO: 4217 - protein, 232 aa, Homo Sapiens
MSPLSAARAALRVYAVGAAVILAQLLRRCRGGFLEPVFPPRPDRVAIVTGGTDGIGYSTAKHLARLGMHVIIVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWAT

SEQ ID NO: 4218 - protein, 154 aa, Homo Sapiens
  misc_feature (1)..(1): Xaa can be any naturally occurring amino acid
XPARPGPTLPSPRVWPPRLSRVGLQPSSPRAAAPPRTLTPPGHGRGPGGSHAPRPRHQAALPAACGRPVTARPRQAPEGRSGRPRDLDPYPPQVFPPRPDRVAIVTGGTDGIGYSTAKHLARLGMHVIIAGNNDSKAKQVVSKIKEETLNDKET

SEQ ID NO: 4219 - protein, 1369 aa, Homo Sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 4220 - protein, 1370 aa, Homo Sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKGKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENNN

SEQ ID NO: 4221 - protein, 160 aa, Homo Sapiens
  misc_feature (1)..(1): Xaa can be any naturally occurring amino acid
XRPRWSGPPCLLPEPNLPRLELPGRPKARSQCPGRPPLPLPLPAPGSPVSSKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQI

SEQ ID NO: 4222 - protein, 1222 aa, Homo Sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4223 - protein, 1155 aa, Homo Sapiens
MAASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4224 - protein, 1166 aa, Homo Sapiens
MCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4225 - protein, 1194 aa, Homo Sapiens
MFSLDSFRKDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4226 - protein, 1194 aa, Homo Sapiens; identical to SEQ ID NO: 4225

SEQ ID NO: 4227 - protein, 42 aa, Homo Sapiens
MFSLDSFRKDRAQHRQRQCKLPPPRLPPMCVNPTPGGTISRG

SEQ ID NO: 4228 - protein, 42 aa, Homo Sapiens; identical to SEQ ID NO: 4227

SEQ ID NO: 4229 - protein, 42 aa, Homo Sapiens; identical to SEQ ID NO: 4227

SEQ ID NO: 4230 - protein, 138 aa, Homo Sapiens
KAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWDLYSRFSEWKSGTNCSSLSGT

SEQ ID NO: 4231 - protein, 1220 aa, Homo Sapiens [sequence omitted]

SEQ ID NO: 4232 - protein, 1181 aa, Homo Sapiens
MAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPECPKHFLPVVAVAVSLEQCLSKFEDLNKELGLVTC

SEQ ID NO: 4233 - protein, 53 aa, Homo Sapiens
MAVAVAMAGALIGSEPGPAEELAKLEYLSLVSKVCTELDNHLGINDKDLGFSY

SEQ ID NO: 4234 - protein, 33 aa, Homo Sapiens
  misc_feature (1)..(1): Xaa can be any naturally occurring amino acid
XYRTLIDQQVVYIHPSSALFNRQPEWTVPMGHV

SEQ ID NO: 4235 - protein, 6 aa, Homo Sapiens
MGILSV

SEQ ID NO: 4236 - protein, 6 aa, Homo Sapiens
MGILSV

SEQ ID NO: 4237 - protein, 56 aa, Homo Sapiens
MGILSVDLLITLQILPPSANWWKSSPQWLTSCWSTLMRLIHQMAGRYRGTPLCLLR

SEQ ID NO: 4238 - protein, 55 aa, Homo Sapiens
MGILSVDLLITLQILPVFFSNCLFLALYDSVILLKHVVLLLSRSKSTRGEWRRML

SEQ ID NO: 4239 - protein, 145 aa, Homo Sapiens
MGILSVDLLITLQILPVFFSNCLFLALYDSVILLKHVVLLLSRSKSTRGEWRRMLTSEGLRCVWKSFLLDAYKQLNCPPSGFSKDGHILLVYEAYKSRLLVYSHLDLWMTDSVVLTLNFPRQISLCFGKNSAAELYIVSKKEKVP

SEQ ID NO: 4240 - protein, 306 aa, Homo Sapiens
MGILSVDLLITLQILPVFFSNCLFLALYDSVILLKHVVLLLSRSKSTRGEWRRMLTSEGLRCVWKSFLLDAYKQLNCPPSGFSKDGHILLVYEAYKSRLLVYSHLDLWMVKLGEDAPNSSVVHVSSTEGGDNSGNGTQEKIAEGATCHLLDFASPERPLVVNFGSATPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRKKTRLAG

SEQ ID NO: 4241 - protein, 271 aa, Homo Sapiens
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRKKTRLAG

SEQ ID NO: 4242 - protein, 271 aa, Homo Sapiens; identical to SEQ ID NO: 4241

SEQ ID NO: 4243 - protein, 37 aa, Homo Sapiens
  misc_feature (1)..(1): Xaa can be any naturally occurring amino acid
XMLTSEGLRCVWKSFLLDAYKQLNCPPSGFSKDGHIL

SEQ ID NO: 4244 - protein, 58 aa, Homo Sapiens
  misc_feature (1)..(1): Xaa can be any naturally occurring amino acid
XMLTSEGLRCVWKSFLLDAYKQTDSVVLTLNFPRQISLCFGKNSAAELYIVSKKEKVP

SEQ ID NO: 4245 - protein, 77 aa, Homo Sapiens
MEEAKKMISGLQALLLNGSLPEDEQERPLALCEPGVNPEEQLIIIQSRLDQSMEENQDLKKELLKCKQEARNLQGIK

SEQ ID NO: 4246 - protein, 472 aa, Homo Sapiens
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 4247 - protein, 218 aa, Homo Sapiens
MGTQVVMRFNNSLLPTEPSQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 4248 - protein, 683 aa, Homo Sapiens
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 4249 - protein, 266 aa, Homo Sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 4250 - protein, 259 aa, Homo Sapiens
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4251 - protein, 213 aa, Homo Sapiens
MTLRIDYCQGLLVGVSSSGLNIIQIQCQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4252 - protein, 159 aa, Homo Sapiens
MVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4253 - protein, 132 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQ

SEQ ID NO: 4254 - protein, 183 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQFASFQYTCQPCRGQRMLCTRDSECCGDQLCVWGHCTKMATRGSNGTICDNQ

SEQ ID NO: 4255 - protein, 235 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLP

SEQ ID NO: 4256 - protein, 350 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALREPAAAAAALLGGEEI

SEQ ID NO: 4257 - protein, 350 aa, Homo Sapiens; identical to SEQ ID NO: 4256

SEQ ID NO: 4258 - protein, 364 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHRLPRLEPGFVPSLPSHSLVYVCKPTFVGSRDQDGEILLPREVPDEYEVGSFMEEVRQELEDLERSLTEEMALREPAAAAAALLGGEEI

SEQ ID NO: 4259 - protein, 224 aa, Homo Sapiens
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 4260 - protein, 125 aa, Homo Sapiens
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAI

SEQ ID NO: 4261 - protein, 146 aa, Homo Sapiens
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSS

SEQ ID NO: 4262 - protein, 100 aa, Homo Sapiens
MEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4263 - protein, 242 aa, Homo Sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4264 - protein, 199 aa, Homo Sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKT

SEQ ID NO: 4265 - protein, 137 aa, Homo Sapiens
  misc_feature (1)..(1): Xaa can be any naturally occurring amino acid
XAAAPIHDADAQESSLGLTGLQSLLQGFSRLFLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4266 - protein, 724 aa, Homo Sapiens
MDCLCIVTTKKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4267 - protein, 721 aa, Homo Sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4268 - protein, 296 aa, Homo Sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTCESPSNTKVPHDPSRLTHDMQSHDIPVAVPLQIFPMK

SEQ ID NO: 4269 - protein, 234 aa, Homo Sapiens
MDCLCIVTTKKYRYQDEDTPPLEHSPAHLPNQVNAPELVHVAERNLSHLEAGHGVVGHAHLSPFKANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDG

SEQ ID NO: 4270 - protein, 91 aa, Homo Sapiens
MEYEEITLERGNSGLGFSIAGGTDNPHIGDDPSIFITKIIPGGAAAQDGRLRVNDSILFVNEVDVREVTHSAAVEALKEAGSIVRLYVMRR

SEQ ID NO: 4271 - protein, 116 aa, Homo Sapiens
MEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAG

SEQ ID NO: 4272 - protein, 281 aa, Homo Sapiens
MPINGVNLAWKYRYQDEDTPPLEHSPAHLPNQVNAPELVHVAERNLSHLEAGHGVVGHAHLSPFKANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSN

SEQ ID NO: 4273 - protein, 767 aa, Homo Sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4274 - protein, 85 aa, Homo Sapiens
  misc_feature (1)..(1): Xaa can be any naturally occurring amino acid
XGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 4275 - protein, 97 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPC

SEQ ID NO: 4276 - protein, 310 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 4277 - protein, 383 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 4278 - protein, 136 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRGWHSPLFTSALRPYLPALAPTTSSQSPVAGVPHFLIPAHSVPCILKICL

SEQ ID NO: 4279 - protein, 54 aa, Homo Sapiens
MGSRCALALAVLSALLCQVWSSGVFELKLQEFVNKKGLLGNRNCCRGGAGPPPC

SEQ ID NO: 4280 - protein, 723 aa, Homo Sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 4281 - protein, 220 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGGLCLDLGHALRCRCRAGFAGPRCEHDLDDCAGRACANGGTCVEGGGAHRCSCALGFGGRDCRERADPCAARPCAHGGRCYAHF

SEQ ID NO: 4282 - protein, 618 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 4283 - protein, 587 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 4284 - protein, 1785 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4285 - protein, 2413 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4286 - protein, 2403 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4287 - protein, 2542 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4288 - protein, 1785 aa, Homo Sapiens; identical to SEQ ID NO: 4284

SEQ ID NO: 4289 - protein, 2403 aa, Homo Sapiens; identical to SEQ ID NO: 4286

SEQ ID NO: 4290 - protein, 2413 aa, Homo Sapiens; identical to SEQ ID NO: 4285

SEQ ID NO: 4291 - protein, 33 aa, Homo Sapiens
MFNFDTFWKNFKSKLGFINWDAINKDQRSSRIP

SEQ ID NO: 4292 - protein, 33 aa, Homo Sapiens; identical to SEQ ID NO: 4291

SEQ ID NO: 4293 - protein, 95 aa, Homo Sapiens
MFNFDTFWKNFKSKLGFINWDAINKNQVPPPSTRALLYFSRLWEDFKQNTPFLNWKAIIEGADASSLQKRAGRDDQNYNYNQHAYPTAYGGKYSV

SEQ ID NO: 4294 - protein, 123 aa, Homo Sapiens
MFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4295 - protein, 123 aa, Homo Sapiens; identical to SEQ ID NO: 4294

SEQ ID NO: 4296 - protein, 476 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4297 - protein, 386 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKDQRSSRIP

SEQ ID NO: 4298 - protein, 436 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 4299 - protein, 398 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMRNSETSPGMFNFDTFWKNFKSKLGFINWDAINKDQRSSRIP

SEQ ID NO: 4300 - protein, 369 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGNSETSPGMFNFDTFWKNFKSKLGFINWDAINKDQRSSRIP

SEQ ID NO: 4301 - protein, 449 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4302 - protein, 465 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4303 - protein, 36 aa, Homo Sapiens
MLGITSCSDQQAKEGEGIQHRLLLRQPRWERRRKWT

SEQ ID NO: 4304 - protein, 36 aa, Homo Sapiens; identical to SEQ ID NO: 4303

SEQ ID NO: 4305 - protein, 36 aa, Homo Sapiens; identical to SEQ ID NO: 4303

SEQ ID NO: 4306 - protein, 36 aa, Homo Sapiens; identical to SEQ ID NO: 4303

SEQ ID NO: 4307 - protein, 36 aa, Homo Sapiens; identical to SEQ ID NO: 4303

SEQ ID NO: 4308 - protein, 36 aa, Homo Sapiens; identical to SEQ ID NO: 4303

SEQ ID NO: 4309 - protein, 36 aa, Homo Sapiens; identical to SEQ ID NO: 4303

SEQ ID NO: 4310 - protein, 36 aa, Homo Sapiens; identical to SEQ ID NO: 4303

SEQ ID NO: 4311 - protein, 36 aa, Homo Sapiens; identical to SEQ ID NO: 4303

SEQ ID NO: 4312 - protein, 36 aa, Homo Sapiens; identical to SEQ ID NO: 4303

SEQ ID NO: 4313 - protein, 36 aa, Homo Sapiens; identical to SEQ ID NO: 4303

SEQ ID NO: 4314 - protein, 36 aa, Homo Sapiens; identical to SEQ ID NO: 4303

SEQ ID NO: 4315 - protein, 36 aa, Homo Sapiens; identical to SEQ ID NO: 4303

SEQ ID NO: 4316 - protein, 36 aa, Homo Sapiens; identical to SEQ ID NO: 4303

SEQ ID NO: 4317 - protein, 36 aa, Homo Sapiens; identical to SEQ ID NO: 4303

SEQ ID NO: 4318 - protein, 36 aa, Homo Sapiens; identical to SEQ ID NO: 4303

SEQ ID NO: 4319 - protein, 36 aa, Homo Sapiens; identical to SEQ ID NO: 4303

SEQ ID NO: 4320 - protein, 253 aa, Homo Sapiens
MLGITSCSDQQAKEGEGLEGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4321 - protein, 131 aa, Homo Sapiens
MLGITSCSDQQAKEGEGLEGSSTGSSSGNHGGSGGGNGHKPGCEKPGNEARGSGESGIQGFRGQGVSSNMRGQGSSWGSGGGDAVGGVNTVNSETSPGMFNFDTFWKNFKSKLGFINWDAINKDQRSSRIP

SEQ ID NO: 4322 - protein, 201 aa, Homo Sapiens
MLGITSCSDQQAKEGEGLEGSSTGSSSGNHGGSGGGNGHKPGCEKPGNEARGSGESGIQGFRGQGVSSNMRNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4323 - protein, 116 aa, Homo Sapiens
MLGITSCSDQQAKEGEGLEGSSTGSSSGNHGGSGGGNGHKPGCEKPGNEARGSGESGIQGQGSSWGSGGGDAVGGVNTVNSETSPGMFNFDTFWKNFKSKLGFINWDAINKDQRSS

SEQ ID NO: 4324 - protein, 184 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4325 - protein, 99 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKDQRSSRIP

SEQ ID NO: 4326 - protein, 189 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4327 - protein, 203 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4328 - protein, 203 aa, Homo Sapiens; identical to SEQ ID NO: 4327

SEQ ID NO: 4329 - protein, 82 aa, Homo Sapiens
MLGITSCSDQQAKEGEGLEGSSTGSSSGNHGGSGGGNGHKPGNSETSPGMFNFDTFWKNFKSKLGFINWDAINKDQRSSRIP

SEQ ID NO: 4330 - protein, 172 aa, Homo Sapiens
MLGITSCSDQQAKEGEGLEGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4331 - protein, 90 aa, Homo Sapiens
MNMKPATASALLLLLLGLAWTQGSHGWGADASSLQKRAGRDDQNYNYNQHAYPTAYGGKYSVKTPAKGGVSPSSSASRVQPGLLQWVKFW

SEQ ID NO: 4332 - protein, 36 aa, Homo Sapiens
SGNHGGSGGGNGHKPGISRLWLTKWVLLSSHISLVP

SEQ ID NO: 4333 - protein, 152 aa, Homo Sapiens
SSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4334 - protein, 74 aa, Homo Sapiens
  misc_feature (1)..(1): Xaa can be any naturally occurring amino acid
XALLLLLLGLAWTQGSHGWGADASSLQKRAGRDDQNYNYNQHAYPTAYGGKYSVKTPAKASRVQPGLLQWVKFW

SEQ ID NO: 4335 - protein, 201 aa, Homo Sapiens
  misc_feature (1)..(1): Xaa can be any naturally occurring amino acid
XGGGNGHKPGCEKPGNEARGSGESGIQGFRGQGVSSNMREISKEGNRLLGGSGDNYRNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4336 - protein, 109 aa, Homo Sapiens
  misc_feature (1)..(1): Xaa can be any naturally occurring amino acid
XPATASALLLLLLGLAWTQGSHGWVGTAGCTGCGRVITAETCRQRRSELQLQPACVSHCLWWEVLSQDPCKGGSLTFFLGFPGATWPAAVGEVLVGNFLQPPPRPRKAL

SEQ ID NO: 4337 - protein, 96 aa, Homo Sapiens
  misc_feature (1)..(1): Xaa can be any naturally occurring amino acid
XPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4338 - protein, 497 aa, Homo Sapiens
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 4339 - protein, 513 aa, Homo Sapiens
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 4340 - protein, 542 aa, Homo Sapiens
MELRSELPSVPGAATAAAATATGPPVASVASVAAAAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 4341 - protein, 542 aa, Homo Sapiens; identical to SEQ ID NO: 4340

SEQ ID NO: 4342 - protein, 855 aa, Homo Sapiens
MAALGVAEAVAAPHPAEGAETAEAVELSRALSRLLPGLEADSKPGRRRALEALRRALEEPGPAADPTAFQGPWARLLLPRLLRCLSDPAEGCRALAVHLLDLGLRRAARPRDALPRLLPALAARLAGPVPARRPPEACEELRLALVQLLGLAVDLCGAALAPHLDDALRALRCSLLDPFAAVRRESCSCAAALAQATPDHFHMQSESLIGPLMQTISHQHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4343 - protein, 280 aa, Homo Sapiens
MTGGAREKAHIARSPATAQGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4344 - protein, 196 aa, Homo Sapiens
  misc_feature (1)..(1): Xaa can be any naturally occurring amino acid
XLCARCAAPCSTPSPPCAARAAAAPPPWRRPRPVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRS

SEQ ID NO: 4345 - protein, 657 aa, Homo Sapiens
  misc_feature (1)..(1): Xaa can be any naturally occurring amino acid
XSPPCAARAAAAPPPWRRPRPHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4346 - protein, 68 aa, Homo Sapiens
AEGEGLVLPKKIRVRSAVEQWLVNVEKSMFDVLKKFLSQGIEDWNCQMFSQWVLSHPGQVVLTVTFAI

SEQ ID NO: 4347 - protein, 130 aa, Homo Sapiens
DYLEVKRLIFPRFYFLSNAELLDILADSRNPESVQPHLVKCFENIKQLLIWKQDIGPPAVKMLISAEGEGLVLPKYDKCYKLFRFCTTSLFKISALKFLIYYKSALSKLFLQRLYPYVNILLPFHIPYNT

SEQ ID NO: 4348 - protein, 430 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 4349 - protein, 228 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 4350 - protein, 228 aa, Homo Sapiens; identical to SEQ ID NO: 4349

SEQ ID NO: 4351 - protein, 4515 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISDTEIETEFENKYMYYEFPEFPTNLFIDPNRLEFSVKIQNMLTNMEKCITTITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVSLDYQSECLLYIDNVIHMSHTLIQSVIEKKNKNLLEVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKGLPKSDMVTHLKQVVTEFKQELPIIIALGNPCLKPRHWEALQEIIGKSVPLDKNCKVENLLALKMFQYENEINDMSTSATNEAALEKMLFKIIDFWNTTPLPLILHHTEIYSIFIIPSIDDISAQLEESQVILATIKGSPHIGPIKDLVNEWDQNLTLFSYTLEEWMNCQRNWLYLEPVFHSSEIRRQLPAETELFSQVISMWKKIMSKIQNKQNALQITTSAGVLEILQNCNIHLEHIKKSLEDYLEVKRLIFPRFYFLSNAELLDILADSRNPESVQPHLVKCFENIKQLLIWKQDIGPPAVKMLISAEGEGLVLPKKIRVRSAVEQWLVNVEKSMFDVLKKERYIYNIILLFQSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKSLGKHCVVFNCFEDLDYKIVRKFFFGLVQSGAWSCFDEFNLIDLEVLSVIASQILTIKAAKDNYSARFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGWKHWGQSQGRRRKGNCINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQAHLGIYFSINNFTPEVQKSKDQIISCSLAIYHQVRQNMLPTPTKCHYMFNLRDMFKLLLGLLQADRTVVNSKEMAALLFVHEATRVFHDRLIDFTDKSLFYRLLSRELENCFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKTRWQETINQIDNKLEGILGDILLSAACIVYSGILTPEFRQLIVNKWETFCIENGISLSSKFSLIKVMAQKYEISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEETELLNENKETCNPINFPWEKLTSFQRLILVKVLRPESLNNSVRKFITEKMGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSRSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4352 - protein, 453 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 4353 - protein, 4515 aa, Homo Sapiens; identical to SEQ ID NO: 4351

SEQ ID NO: 4354 - protein, 3507 aa, Homo Sapiens
MGRRSQWIWAMRCQMLVPVLSLHIGLARALGCGCIASKIECLIRCNAPFPLLDAVGSVASQELQSLTGTVGVTSGAAAYPRWNLARARAPPHLPGTQDPLRRVRDPTPIVASSPGRRRGSWSGGYGQEASEPGVVGLCCAVLPIHPSLALAGVGGPDLRRFQEGPQRPSDHGAAEKHMETFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISATITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKEIYSIFIIPSIDDISAQLEESQVILATIKGSPHIGPIKSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKCALFAFKCNTALIKLPNSLIVLTCFGLEKTVLVMNTVMSFRFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCDTSDSLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGINLPTGECSIFGYFVDIEQCEFIPWSDLVPNDQTLIQRDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLISRWHNQGLPHGQYSVENAILIKNGQQWPLLIDPHRQAHKWIRQMEGSRLQKLSIEDSNYTKKIENAMKTGGSVLLQSCQASTWRKKLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEEKHTFCLLLRAINHTGTDLGPVGRGQWLTSTACDRHTDVCSFSFALNDGVPDVEHVQDIFYGHCVDKYHVKVLRPESLNNSVRKFITEKMGNKYLQRTGVNLKDAYKGSNARTPLILIQTHGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4355 - protein, 1481 aa, Homo Sapiens
  misc_feature (1)..(1): Xaa can be any naturally occurring amino acid
XELFGNSSQVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQLLLGLLQADRTVVNSKEMAALLFVHEATRVFHDRLIDFTDKSLFYRLLSRELENCFQIQWTQENLMNHSTVFLDFLDINKTHRKKIYQNTSDYNKLASVLDEFQMKLGSISLELSHSMVFFKEAIEHIIRATRVLRQPGSHMLLIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEESKSS

SEQ ID NO: 4356 - protein, 1477 aa, Homo Sapiens
  misc_feature (1)..(1): Xaa can be any naturally occurring amino acid
XELFGNSSQVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQLLLGLLQADRTVVNSKEMAALLFVHEATRVFHDRLIDFTDKSLFYRLLSRELENCFQIQWTQENLMNHSTVFLDFLDINKTHRKKIYQNTSDYNKLASVLDEFQMKLGSISLELSHSMVFFKEAIEHIIRATRVLRQPGSHMLLIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEE

SEQ ID NO: 4357 - protein, 126 aa, Homo Sapiens
  misc_feature (1)..(1): Xaa can be any naturally occurring amino acid
XLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 4358 - protein, 204 aa, Homo Sapiens
  misc_feature (1)..(1): Xaa can be any naturally occurring amino acid
XMLISAEGEGLVLPKKIRVRSAVEQWLVNVEKSMFDVLKKFLSQGIEDWNCQMFSQWVLSHPGQVVLTVSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLME

SEQ ID NO: 4359 - protein, 219 aa, Homo Sapiens
  misc_feature (1)..(1): Xaa can be any naturally occurring amino acid
XRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4360 - protein, 300 aa, Homo Sapiens
  misc_feature (1)..(1): Xaa can be any naturally occurring amino acid
XTGVSHRADGERGTVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPR

SEQ ID NO: 4361 - protein, 358 aa, Homo Sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 4362 - protein, 358 aa, Homo Sapiens; identical to SEQ ID NO: 4361

SEQ ID NO: 4363 - protein, 223 aa, Homo Sapiens
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 4364 - protein, 153 aa, Homo Sapiens
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 4365 - protein, 504 aa, Homo Sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 4366 - protein, 453 aa, Homo Sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 4367 - protein, 60 aa, Homo Sapiens
MRGMKLLGALLALAALLQGAVSLKIAAFNIQTFGETKMSNATLVSYIVQGCTRHLSLRGQ

SEQ ID NO: 4368 - protein, 60 aa, Homo Sapiens; identical to SEQ ID NO: 4367

SEQ ID NO: 4369 - protein, 60 aa, Homo Sapiens; identical to SEQ ID NO: 4367

SEQ ID NO: 4370 - protein, 282 aa, Homo Sapiens [sequence omitted]

SEQ ID NO: 4371 - protein, 282 aa, Homo Sapiens [sequence omitted]

SEQ ID NO: 4372 - protein, 86 aa, Homo Sapiens
MRGMKLLGALLALAALLQGAVSLKIAAFNIQTFGETKMSNATLVSYIVQILSRYDIALVQEVRDSHLTAVGKLLDNLNQWVTVAGS

SEQ ID NO: 4373 - protein, 108 aa, Homo Sapiens
NREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRLPMA

SEQ ID NO: 4374 - protein, 72 aa, Homo Sapiens
SIRLWTSPTFQWLIPDSADTTATPTHCAYDRIVVAGMLLRGAVVPDSALPFNFQAAYGLSDQLVCVLPCTAT

SEQ ID NO: 4375 - protein, 90 aa, Homo Sapiens
  misc_feature (1)..(1): Xaa can be any naturally occurring amino acid
XHYVVSEPLGRNSYKERYLFVYRPDQVSAVDSYYYDDGCEPCGNDTFNREPAIVRFFSRFTGSVPHTTWLSPQRSGSLPLFPCMRPRGTQ

SEQ ID NO: 4376 - protein, 75 aa, Homo Sapiens
  misc_feature (1)..(1): Xaa can be any naturally occurring amino acid
XRYLFVYRPDQVSAVDSYYYDDGCEPCGNDTFNREPAIVRFFSRFTGSVPHTTWLSPQRSGSLPLFPCMRPRGTQ

SEQ ID NO: 4377 - protein, 65 aa, Homo Sapiens
  misc_feature (1)..(1): Xaa can be any naturally occurring amino acid
XTFQWLIPDSADTTATPTHCAYDRIVVAGMLLRGAVVPDSALPFNFQAAYGLSDQLVCVLPCTAT

SEQ ID NO: 4378 - protein, 26 aa, Homo Sapiens
MHYPTALLFLILANGAQAFRICAFNA

SEQ ID NO: 4379 - protein, 85 aa, Homo Sapiens
MHYPTALLFLILANGAQAFRICAFNAQRLTLAKVAREQVMDTLVRALNISDHYPVEVELKLSQAHSVQPLSLTVLLLLSLLSPQL

SEQ ID NO: 4380 - protein, 62 aa, Homo Sapiens
MHYPTALLFLILANGAQAFRICAFNAQRLTLAKVAREQVMDTLVRDVILLGDFNADCASLTK

SEQ ID NO: 4381 - protein, 104 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYR

SEQ ID NO: 4382 - protein, 208 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHW

SEQ ID NO: 4383 - protein, 302 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 4384 - protein, 302 aa, Homo Sapiens; identical to SEQ ID NO: 4383

SEQ ID NO: 4385 - protein, 302 aa, Homo Sapiens; identical to SEQ ID NO: 4383

SEQ ID NO: 4386 - protein, 302 aa, Homo Sapiens; identical to SEQ ID NO: 4383

SEQ ID NO: 4387 - protein, 302 aa, Homo Sapiens; identical to SEQ ID NO: 4383

SEQ ID NO: 4388 - protein, 302 aa, Homo Sapiens; identical to SEQ ID NO: 4383

SEQ ID NO: 4389 - protein, 278 aa, Homo Sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 4390 - protein, 278 aa, Homo Sapiens; identical to SEQ ID NO: 4389

SEQ ID NO: 4391 - protein, 299 aa, Homo Sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 4392 - protein, 299 aa, Homo Sapiens; identical to SEQ ID NO: 4391

SEQ ID NO: 4393 - protein, 299 aa, Homo Sapiens; identical to SEQ ID NO: 4391

SEQ ID NO: 4394 - protein, 254 aa, Homo Sapiens
PRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDWAAIRLRSSEVFKWLIPDSADTTVGNSDCAYDRIVACGARLRRSLKPQSATVHDFQEEF

SEQ ID NO: 4395 - protein, 137 aa, Homo Sapiens
ADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRPWMSATTFQLNLNYSLQGPSPTAKNLSL

SEQ ID NO: 4396 - protein, 275 aa, Homo Sapiens
MSRELAPLLLLLLSIHSALAMRICSFNVRSFGESKQEDKNAMDVIVKVIKRCDIILVMEIKDSNNRICPILMEKLNREKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 4397 - protein, 100 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKE

SEQ ID NO: 4398 - protein, 158 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTP

SEQ ID NO: 4399 - protein, 305 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 4400 - protein, 288 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEVRLPSCLSMPLSWKDELAWAT

SEQ ID NO: 4401 - protein, 218 aa, Homo Sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQV

SEQ ID NO: 4402 - protein, 360 aa, Homo Sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 4403 - protein, 361 aa, Homo Sapiens
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 4404 - protein, 153 aa, Homo Sapiens
MPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 4405 - protein, 107 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHR

SEQ ID NO: 4406 - protein, 111 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRM

SEQ ID NO: 4407 - protein, 411 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 4408 - protein, 411 aa, Homo Sapiens; identical to SEQ ID NO: 4407

SEQ ID NO: 4409 - protein, 411 aa, Homo Sapiens; identical to SEQ ID NO: 4407

SEQ ID NO: 4410 - protein, 161 aa, Homo Sapiens
MKLQTLAVSVTALKFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAP

SEQ ID NO: 4411 - protein, 123 aa, Homo Sapiens
MQMIIIWALLDTEAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVA

SEQ ID NO: 4412 - protein, 114 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSY

SEQ ID NO: 4413 - protein, 137 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVP

SEQ ID NO: 4414 - protein, 486 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 4415 - protein, 486 aa, Homo Sapiens; identical to SEQ ID NO: 4414

SEQ ID NO: 4416 - protein, 258 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEMLWHGGPWKCHRHL

SEQ ID NO: 4417 - protein, 513 aa, Homo Sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 4418 - protein, 357 aa, Homo Sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4419 - protein, 357 aa, Homo Sapiens; identical to SEQ ID NO: 4418

SEQ ID NO: 4420 - protein, 378 aa, Homo Sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 4421 - protein, 412 aa, Homo Sapiens
MFYGRINGRNFAASSLPVAFAATPLMLFLPNPQLIFSFPISSRNHITGLMPPGKLKLENLFHMCTRLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4422 - protein, 412 aa, Homo Sapiens; identical to SEQ ID NO: 4421

SEQ ID NO: 4423 - protein, 367 aa, Homo Sapiens
MGFTDLEEPISGCPGGPWALGLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4424 - protein, 367 aa, Homo Sapiens; identical to SEQ ID NO: 4423

SEQ ID NO: 4425 - protein, 170 aa, Homo Sapiens
MKTPWKVLLGLLGAAALVTIITVPVVLLNKGNDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLVSICLEQ

SEQ ID NO: 4426 - protein, 766 aa, Homo Sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 4427 - protein, 118 aa, Homo Sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 4428 - protein, 118 aa, Homo Sapiens; identical to SEQ ID NO: 4427

SEQ ID NO: 4429 - protein, 86 aa, Homo Sapiens
  misc_feature (1)..(1): Xaa can be any naturally occurring amino acid
XDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 4430 - protein, 272 aa, Homo Sapiens
APWAPVLLLALGLRGLQAGARRAPDPGFQERFFQQRLDHFNFERFGNKTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGRKPSHLSSQPPAQLGCAATLAAFPSESCTRTWPRVGICGSQKCRPPCGTCGPLRRKRGNGVLGAAALTLCPSPSYGGMLSAYLRMKYPHLVAGALAASAPVLAVAGLGDSNQFF

SEQ ID NO: 4431 - protein, 492 aa, Homo Sapiens [sequence omitted]

SEQ ID NO: 4432 - protein, 61 aa, Homo Sapiens
  misc_feature (1)..(1): Xaa can be any naturally occurring amino acid
XSGSEHCYDIYRLYHSCADPTGCGTGPDARAWDYQISEPPATSSSPTGTWTPGQGAGFGGT

SEQ ID NO: 4433 - protein, 155 aa, Homo Sapiens
  misc_feature (1)..(1): Xaa can be any naturally occurring amino acid
XTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGSLRHGPLGVRHLPAAVRREGPDPALHVRPECLHRAGHDGLPLPH

SEQ ID NO: 4434 - protein, 244 aa, Homo Sapiens
  misc_feature (1)..(1): Xaa can be any naturally occurring amino acid
XTVRWEFGTCQPLSDEKDLTQLFMFARNAFTVLAMMDYPYPTDFLGPLPANPVKVGCDRLLSEAQRITGLRALAGALPPAPDGCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 4435 - protein, 120 aa, Homo Sapiens
  misc_feature (1)..(1): Xaa can be any naturally occurring amino acid
XVLLLALGLRGLQAGARRAPDPGFQERFFQQRLDHFNFERFGNKTFPQRFLVSGSGSGARGPSSSTLGTRATCGPSPTTRPSSRSWRPSGGLYWSSRSTATTGSRCRSVRSPRSAGTRSC

SEQ ID NO: 4436 - protein, 201 aa, Homo Sapiens
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 4437 - protein, 349 aa, Homo Sapiens
MAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 4438 - protein, 136 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQ

SEQ ID NO: 4439 - protein, 139 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSW

SEQ ID NO: 4440 - protein, 144 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDA

SEQ ID NO: 4441 - protein, 228 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLYNYLSKTQQEKFLEVIANASGYMYETSYRRGWGFQYLHNHQPTNCMALLTGSLVLMNQGMMAA

SEQ ID NO: 4442 - protein, 228 aa, Homo Sapiens; identical to SEQ ID NO: 4441

SEQ ID NO: 4443 - protein, 958 aa, Homo Sapiens [sequence omitted]

SEQ ID NO: 4444 - protein, 308 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLYNYLSKTQQEKFLEVIANASGYMYETSYRRGWGFQYLHNHQPTNCMALLTGSLVLMNQGYLQEAYLWTKQVLTIMEKSLVLLREVTDGSLYEGVAYGSYTTRSLFQYMFLVQRHFNINHFGHPWLKQHFAFMYRTILPGMMAA

SEQ ID NO: 4445 - protein, 958 aa, Homo Sapiens [sequence omitted]

SEQ ID NO: 4446 - protein, 958 aa, Homo Sapiens [sequence omitted]

SEQ ID NO: 4447 - protein, 1118 aa, Homo Sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 4448 - protein, 232 aa, Homo Sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREVS

SEQ ID NO: 4449 - protein, 1301 aa, Homo Sapiens
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSNSSDSSDSSDSSDSSDSSDSSDSSDSSNSSDSSDSSDSSDSSDSSDSSDSSDSSESSDSSDSSNSSDSSDSSDSSDSSDSSDSSDSSDSSDSSNSSDSSDSSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 4450 - protein, 1301 aa, Homo Sapiens; identical to SEQ ID NO: 4449

SEQ ID NO: 4451 - protein, 123 aa, Homo Sapiens
EMTRKQPDVDKVTKTYKRRAADPSSLQSHIPVLDKGRAGRKRFPASSLYPSGSQTQIETKNPRVNLLVSKWQQVWLLALERRRKLNDALDRLEEVWKFIPSTPHCHLPSFLITHCHCQNLGIF

SEQ ID NO: 4452 - protein, 7461 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4453 - protein, 5375 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4454 - protein, 5497 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4455 - protein, 1674 aa, Homo Sapiens
MGKPLSRPDCLRQNPPCVGKGEEEEDLNIEDCYVPQRSIYDTVRLNEQIDSGSKGSLSSRHFTDRTLPYSHRTLDVSSLCSNGALTSSSVFELRGREANKLDEKMIFDALKLNSDIIRTTGLPKAKSHAEKKEHRRSWRMFVPANFMDYANKSESSFVEPADMSDAVTKASKCRWGTNSLTSEEDDSGLCSPPAEREEKQGILTGDQSRIKSLSSTEDILVTDQYRPFFSVNSISEQKIPLLSCQSAHPDENFKMILHDVSPLEEAKHVNGQREIHDENCCLQNNLKESPVKCDPLIMPRNRENEHIFNLGEEDETYGPGESQITAQSRELLKDSPQDLDLSHTDLGESDVDCGSTSLVENVTLLTQYDSGECNIASKEEVEAPLSAQESEMLYKKFSLKFVSARKKAAPRKTGAQAGILDTVCNGFQLVQVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQD

SEQ ID NO: 4456 - protein, 304 aa, Homo Sapiens
MGNVCGCVRAEKEEQYVDPAKTPLNPEKYSPGRKYFRRKPIKKTGGDKESVGANNENEGKKKSSSQPSKEQPAPLSRGLVQQESVTLNSALGDGIQQKKTEVVADSVKQKLLPSAVSSWSDCVNTSPAKDSETEVKVSELDERISEKDSTPYCAKRKKHLDDVNTSEITFQEKTDVFSFRKAASLSSIPSGIERSLEKSGFPEDPPKSYSSIQEKQNTERFCPHATQHFQFKKKRCHSLYTSMSSVSKDTDGNEISDIHVTGESEDMSAKERLLLWTQQATEGYAGIRCENFTTCWRDGKLFNA

(The sequence listing continues in the following parts.)

What is claimed is:

1. A method of expressing a transgene comprising:
   a) providing a population of T-cells wherein a plurality of T-cells in the population comprise at least one chimeric antigen receptor (CAR) and at least one inducible transgene construct,
   wherein the CAR is a transmembrane protein comprising (i) an ectodomain comprising a a signal peptide and a ligand recognition region, wherein the ligand recognition region comprises at least one scaffold protein; (ii) a transmembrane domain; and (iii) an endodomain comprising at least one costimulatory domain,
   wherein the at least one inducible transgene construct comprises a sequence encoding an NFκB-inducible promoter and a transgene; and
   b) contacting the population of T-cells with a ligand that binds to the ligand recognition region of the at least one CAR,
   wherein upon binding of the ligand to the ligand recognition region, the endodomain of the at least one CAR transduces an intracellular signal that targets the NFκB-inducible promoter and results in expression of the transgene within the plurality of T-cells.

2. The method of claim 1, wherein the ectodomain of (i) further comprises a hinge between the ligand recognition region and the transmembrane domain.

3. The method of claim 1, wherein the at least one scaffold protein comprises an antibody, an antibody fragment, a single domain antibody, a single chain antibody, an antibody mimetic, a single chain variable fragment (scFv), a VH, a VHH or a Centyrin.

4. The method of claim 1, wherein the CAR specifically binds to BCMA or MUC-1.

5. The method of claim 1, wherein the transgene comprises a sequence that is endogenous with respect to the genomic sequence of the T-cell.

6. The method of claim 1, wherein the transgene comprises a sequence that is exogenous with respect to the genomic sequence of the T-cell.

7. The method of claim 6, wherein the exogenous sequence is a synthetic, modified, recombinant, chimeric or non-naturally occurring sequence with respect to the genome of the cell.

8. The method of claim 1, wherein the transgene encodes a secreted protein.

9. The method of claim 8, wherein the secreted protein is Factor IX.

10. The method of claim 1, wherein, the signal peptide comprises a sequence encoding a human CD2, CD3δ, CD3ε, CD3γ, CD3ζ, CD4, CD8α, CD19, CD28, 4-1BB or GM-CSFR signal peptide.

11. The method of claim 1, wherein the transmembrane domain comprises a sequence encoding a human CD2, CD3δ, CD3ε, CD3γ, CD3ζ, CD4, CD8α, CD19, CD28, 4-1BB or GM-CSFR transmembrane domain.

12. The method of claim 1, wherein the endodomain comprises a human CD3ζ endodomain.

13. The method of claim 1, wherein the at least one costimulatory domain comprises a human 4-1BB, CD28, CD40, ICOS, MyD88, OX-40 intracellular segment, or any combination thereof.

14. The method of claim 1, wherein the NFκB-inducible promoter comprises 1, 2, 3, 4 or 5 repeats of the NFκB response element.

* * * * *